United States Patent 7,745,391 (HUMAN THROMBOSPONDIN POLYPEPTIDE) - sequence listing, part 117

SEQ ID NO: 336425 - DNA, 3401 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggaacgctgcacttagatataacatccttcacttaaaaaattaaaaacatcagtactaccaccaccaccaacaacatcaacacagatcttcacatctgcc

SEQ ID NO: 336426 - DNA, 2809 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtt

SEQ ID NO: 336427 - DNA, 2705 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccagcgccctttggtttttgttttagaacaaggaagggttaaatggtggctggtcgacgcgg

SEQ ID NO: 336428 - DNA, 2018 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagt

SEQ ID NO: 336429 - DNA, 1471 bp, Homo sapiens
  misc_feature (1404)..(1404): n is a, c, g, or t
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagagntcatgctgagatcgttatgcccatcatccgagcacatttaacgtcagctgagacattggcactgcca

SEQ ID NO: 336430 - DNA, 1489 bp, Homo sapiens
  misc_feature (1422)..(1422): n is a, c, g, or t
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagagntcatgctgagatcgttatgcccatcatccgagcacatttaacgtcagctgagacattggcactgcca

SEQ ID NO: 336431 - DNA, 3080 bp, Homo sapiens
ggggaactgtcaaagacgaattaactgacttggatcaatcaaatgtgactgaggaaacacctgaaggtgaagaacatcatccagtggcagacactgaaaataaggagaatgaagttgaagaggtaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336432 - DNA, 2896 bp, Homo sapiens
ataggctaggagcgaggccgcggtggtgatttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336433 - DNA, 3272 bp, Homo sapiens
agcgcatggactgaggtgcggggaagccggcccctcaccgaagctttccgtagttacggaggagcttgggggtccatcgctgcttactgcgcagagctgctcctttgaggtgctgttgtttcaggctcctgtcctgccgtcttgtcccacgacggcgcggagtatccccgctgaaaagcagggggtcgttccaggccatcagacgtgtggagtaagctgcaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336434 - DNA, 2821 bp, Homo sapiens
ctgacgtcgactggtttagtatttttagtaagaaaggagttagagaatgtgagagcttatggtatttttgtatgaagaacttttcagctacatgtaaatggacctagatgcctttctttttctttctttccttagagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336435 - DNA, 2997 bp, Homo sapiens
ctagaggattaccttcttgtatgttattaagagttacatattgtgggaattatggaaattaaaaatgtggtttaggagaagataggctgaggattttacataagagggtagtttttaaacaaggtagtgtttttaagaaatgtgtattttagtattcgtaaagccagttctagattgtattactgataaatgatcatttaagagttcataagtatgaattccatattccttacttgtctctaattagcaaacactgaattcctggtctctaccaagttgcttagttacataggaaactagggtaccctcatccttgaataatctttctctaaaagattacaaggttaattttctcaattaaaatcataaatttaaaatacttttatgtaatatcagctctctaccaggtataaaacttgaaaaccttttcacagggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336436 - DNA, 3028 bp, Homo sapiens
gcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagtcagctcagctcagctcagctcagctcagctcagctcagcagctcagctcagctcagctcagctcagctcagctcagcagctcagctcagctcagctcagctcagctcagctcacagtcagtcagtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336437 - DNA, 229 bp, Homo sapiens
aatggtgactgctttcaagtcttagttgctcagtaatcacaatttcagcaccaatgagtgatgccctgttgatgaatgacacccagtgcctcaggtctgaaatagtttctgacactaataagatattttgactgcaaatgtaaagcttaaggagttgaagttcaaagatagagtaatctatcaattagattgatcactaatcattcccccacatcagttgtaattcaag

SEQ ID NO: 336438 - DNA, 409 bp, Homo sapiens
agcaataactaataacctaaatatatgatggtgccaacaccatggatttgttgtgaaaattcaaaagtgttaataagtataaagtacctagaacaacacctgaacatagtgggtgctcattaaagtgacctattgcttttgttgctattcatgacactttctgaatctactcctctcaacggcattggtctcttgacaccacacccatctggttatcctctttgtttttttgttttgttttgagacagaatctcattgtgtcgcccaggcctgagcgcagtgatgcaatcatagctcactgcagcctcaaactcctgggctcaagcaatcctcctgcctcagcctcccagaatgctgaaattacaggcatgggccaccacgcccagacaccactgtgctattgaaactt

SEQ ID NO: 336439 - DNA, 234 bp, Homo sapiens
ctggccggatgtttatttttattgtgccaagctggggatgcaacaatgaacaggacaaagatcctgaccttgggatctcagagctcatgagaaaggcagacaccttattctgggcttttaattcaggtgggatggggacacctaaggggcctgttggaggaacaccccacccaggagttaaagaaggaaagcttcctggaggaggtagcatcccagctgggctatgaaagagaa

SEQ ID NO: 336440 - DNA, 280 bp, Homo sapiens
agctcatcaaaatactcattctactttatagaatgaggtgtgcctgattttagaattataaacaaaagccaataagatctttacactaaatttgtggtaattttaccttttcacaatagtaagcctgaagctagtggttatgcaatgataagaacataataatggctaatgtttattgaacaatcaatttgtcccatgcactgtagcctttacatatactatcacatttaattaccaaaatgcctttctggtatatcattgcacaaaaatacacggtggg

SEQ ID NO: 336441 - DNA, 195 bp, Homo sapiens
cacaggggatgggaaggttggagaggactataactgactcactcttatttcagaaccaaaagcaatgggggaagtcagagcagagaagatttcagctcaacctgaaatggaacttcctatcaatgagaatgtgacaattacaggaggggcttccttgtgaggtagtgaactctccctgttatacaaagtcattga

SEQ ID NO: 336442 - DNA, 650 bp, Homo sapiens
ggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattcgagaggggactaagaaattcagaagtattgggagctactgtctgttgaaagtgtttgagatgag

SEQ ID NO: 336443 - DNA, 296 bp, Homo sapiens
agcttcagaggttgttggttccaactgtggaagggctcaggaaggatttgatgggatggggtggctcaggggacccagggaggaaagtgagcagcaaagcatggaggccagagaagcattttaagggagaaagctgacagtggcccttgaaatgaatgaaggaaggaagactcatcagtgaatgagaacaggaagtacaggagtgaggtgatggagtgaagccacggaacggacaggaggggctgggtggttaaataacccctcctgccctcctccgcctcccttcagacttccaa

SEQ ID NO: 336444 - DNA, 570 bp, Homo sapiens
gaggctgtgcacccccgcaaaggctcctgcccagcgtccagcctatccgcggggactccacgtgcaccccctcctcattgtccttgtctagggcctcggcaagctcctcgctcccatggcgtgacttcaggggcgcaggagcctgggctgagcaggtggagtagggtgagcaccgccaagaacccagtgagagtggcgccccagggcggcacaggaggccgcatttaacgtgtcaatcatctcaaagatattatggcatcttcttttttttgacatcttataatatctataatgtctattatatcttgtgatagaattattaacaccacttcattgtgattattatgattatttttataccaacacatcttcaattattaatattcccagttgctagagaaaaatgaaacgactagttttgaaagccttacttctgccaatggaagcacattccagcatgtcgccaacgcaatccattttccaccactttcacaagaaaagttacggcacaattatactatcctacccttatatactttttgtgcatgtgtacttgtatgtatgtatgtt

SEQ ID NO: 336445 - DNA, 483 bp, Homo sapiens
agtgcagtgaatagaagacacttctctgcaccccaaaagctccatgctgattgcgagaaggaaatgctggatggaggggttcctggaactactgtgagggaaatggtaacagaactttggatgtggaacgtgcagtaggagttacacgaagtgcgggtctgcacttggggtggtcagcacggcggatgcccagcaaaggcactgcctggtccacatcccggagtggtctctacgccccagtcggcatcgcagctgatggtgaaacttttggtgtggcagaagagtgtccacaaactttggaagttgctagagaaaaatgaaacgactagttttgaaagccttacttctgccaatggaagcacattccagcatgtcgccaacgcaatccattttccaccactttcacaagaaaagttacggcacaattatactatcctacccttatatactttttgtgcatgtgtacttgtatgtatgtatgtt

SEQ ID NO: 336446 - DNA, 101 bp, Homo sapiens
attttttttctttttgcacacggtgggagatcttttttgttttgcattgatctgtgttggtggcgctgtagtgctcctcaacaatttatgtcagtttcact

SEQ ID NO: 336447 - DNA, 258 bp, Homo sapiens
gtgggaaggccagagcagacaggttttcctcctgtgggttccctccggctaggccccaggagttgtctgaatcgactcactaacattaaccagcttgtggccatctgtactctaccaattatacatccggaagatgaaccagacagagccctggggcatcccactacagaccttcttacaggttgattccttggatcaacttttcccttttgttcccttgaggggctctcagtctttaagagacagagtgagacacag

SEQ ID NO: 336448 - DNA, 421 bp, Homo sapiens
agcctaaatgagattctaggtactatctgataaggaaaagtgaccatgcagccattttgagaaggattaaatttaggggcagcatcaaggtctttctaggtctactataaatgggccacaaactcttaggactggaacaagaattatgtgtctctgaaaataggaagatgtggccgggcacgatggctcacacctgttatcccagcactttgggaggctgaggctggcagatcacctgaggtcaggagttcaagaccagcctgaccaacatggagaaactttgtctctactaaaaatacaaaaaatagccaggtagcacgcctgtagtcccagctactgtggaggctgaggcagttggaggctgagacaggagatcttggcagtaagccaagatcgtgccactgcactccagctctgtctc

SEQ ID NO: 336449 - DNA, 113 bp, Homo sapiens
cctccccgtcttccttcccctccccatgtggcctggccagaacctcttaaatccaggcccttagacctaagggaaggctttctgctcttcaacagtagaacagtttctgtcac

SEQ ID NO: 336450 - DNA, 302 bp, Homo sapiens
ggtgcaaggtgagagtgaggttaaaggtcagagaggaggggctgaggaggccatctcccaccaggagcagacagctggtggcttgagactggggtggagctgcgtgggggatgggaggggactgagcatggggcttcatcttcactgcccactcctcccctctccctggctgtgcccgccttctgggattgtaggattccagcagctggcgccccaggtgctgctgcggctgaggaaggcaatcccagtcagctgccttctcgattccagggtggctgtagccagaagcaggaccagataag

SEQ ID NO: 336451 - DNA, 87 bp, Homo sapiens
atgattaaatttattaaaaccttaatttgtatgcaaggtttcaggatcatttagatcactttagaagaggttataaactgtagagta

SEQ ID NO: 336452 - DNA, 438 bp, Homo sapiens
aaacaggctgaggtttaaggcatttaaataactgtgttcaaggacctggaaccagaatccaatcccaggtttgacgggccccaatgtctgtacctctaactgccctccagagaagcagggctccatggcaaagacagaacttgaccaaagttgtgtccaagcccatgggagcagtatctgatgtatttaattcccaggcttcctatgcagtagcacgtctttattgattctgcagggtctgggtgcctggcagaagataagtggaatccacatccttccacttcagccacaacatgagacatacctcatcacctcttttcttagatacttatagtccctaaaattaagccattgggttgacgagacatacaaggataaaacaggagacaaaaataaccctcatgaagtggaggtcagtgctgttgatggagctgtgta

SEQ ID NO: 336453 - DNA, 986 bp, Homo sapiens
cagtgtgaatccctggaaggcaagatcgccattctggtctcttgtggatatcaatgctgatctcagcttctgatgcacggcagtcaattaataaatgattgttgcctgaaaaactgagccccaaaacaatattacaagtttaatatcagtaaaggatttaatgctttctaacatgaagataccagaagttgctgatttttgtataacccagagatggatttaaatgcagagtgtatgaacttcttcattcctgagggaggacttatgatttcatgagaaatgccctaggaaaggggccggggagactgatggagaagaagagtttgggagggaagccccaaggaccatctgccccatcagagtcacatgcagagggtcctgctcctgccgttggaagttggcttcctgagctgctgaacgtgccagtcctgctgacccactctcagatatcacaggcacccgctgtgtctgacagagacctttctgcaagtacacgtgcaggtctgctctgcaaaggcgttatcatctgcagattattgcacagagtggctacgagctgtggtgtgatcctgtcacagagagagcctggtcacgttttcagaacagcaggaaacaggtacacctgtaagcttatacttatcagatttaaaaataaaacaaaaaatccatgctattccatgaaaatcggactcaaataaacttagtcactgatctgtgaagtaaataatctgatggtaacgcatcagttgacacttgggcctgggtttttaggcactaatgaaagccaggggcaaaataatttttaatctaccattatttcccttgatggttcgacaaaagttcttgtactagaaagttttataaaactactttctgagtgtcctgtgacatttctctgatgatataaaaagtcaatatttgatagcttaaatatcaatattgacagaaatatgattatttaaataaaaacacaaatagtaaaataa

SEQ ID NO: 336454 - DNA, 537 bp, Homo sapiens
  misc_feature (435)..(435): n is a, c, g, or t
  misc_feature (487)..(487): n is a, c, g, or t
tgaatttatttaaaaatacatgtgattgttttacataatatgacttgctagaaaattttaagtttatataaataatgataaagtacacttgaaatatattttaattgattctatctctagcaaataccagataatattttttatttatgcggggtttttctaacatatatattaaaaaaacatatatttctgtaagtcatattcttttctctttttctaagccatacatactctcccaccatttatgtactttatagatttgtagatttttagtagtagaactaaaatggaatttaattgctgagcatttgcgggcaaagaccagtggttcagttccttcctgctgcaggtggaaaaccattcctcctggcaccgtctgtttgtggacccgttaagccgcgccatgtacagctctgacggcccggattttgagtntgtgcagcagaagcgtaaagaggggctgagtattcatgaagcagtgtggcanctggcgtgaaaaagtcaagggccggaatggcttccttgaacctggctggc

SEQ ID NO: 336455 - DNA, 502 bp, Homo sapiens
ccaacaggaatcctgatggtcccacagaggcccctgaggtactgaccagcgtcaccccatttctgcatggagcaatttgcataaacatctggcaaatggagtgggagagagatgacacccaacaagtatataatctgtgccaagtcctttgtcatgtacttagcctgtgacactctatttaccctccatatcaacgccagaaagtagactttgctcccattctataggcaaggccacagaggctgagcgatgtgcctgatgtcaccggcttgtcaagaggcatgcagaaatgtgaactctgaactctgaagctcaagctcatttaaaggtgccctggggagtgcttgcactaccaaagccaaggactcccaaagccccatctgggccagcaatgctccgtcttatcctcactgtcctgcttcccatcctcagcctctcggagctgctcccaaacaaacgactgaagaggagaatgggagggtttcccatgtcctcctgccca

SEQ ID NO: 336456 - DNA, 299 bp, Homo sapiens
tttctgtattcatttatcccggacttgggagtaattatgtcaggatctttttcccaaggactctaggaaagcaaagcaactttccacccaattctctttcatgaaaggctttgctttcttcgaatgcgtgtttgctgtttatttcagcctcccaggcagccaagggaccgttcaggacaagtttctcatcagcaacaggtgtcttattactacagtggctcatcgttagtggaacccccagcttctggctgcaggaagtacaggaaaaatttgcaaaggaggttactctagcctttctg

SEQ ID NO: 336457 - DNA, 552 bp, Homo sapiens
gagttccagaccagcctggggaacatagtgagaccccagctctacaaaaaaaatttttttaattagccaggcatggtagtgtgtgcctgtagtcccaagtactcaggagggtgaggcaggaggattgcttgagcccaggggttggaggctgcagtgagccatgatcacaccgctgcactccagcctgagtgacagagtgagaccctaaaaaaaaaagagagagaaagaagaaaagtctggatggagaggagtgtgaaaagaggttagggagggcagccaggacagatctgaaggacacagggtttgggtttgttttaagagtggtgggggctgggcacagtgactcaagtttgtaatcccagctctttgggaggctgaggcgggaggatcacttgaggttaggagaccagcctggccaacatgatgaaaccctgtctctactaaaaatacaaaaattagctgtaatcccagctactcgagaggctgaggcaggagaattgcttgaacccgggaggcggagtttgcagtgaactgagattgcgccactgcact

SEQ ID NO: 336458 - DNA, 227 bp, Homo sapiens
ctgtaatgtgattctattacttttataatttaaaaattagcttttgaagcattataaaaattaatttacaaaatgtacatcaaaaaataaataagacatcttaaagaccctgtcttagtaattcgcaagatgagatactaagagagttaggatcaggagcttcctagttcaggagtcagtaaggccattttctccaacaccaccactccgccaaatggaggcagcct

SEQ ID NO: 336459 - DNA, 324 bp, Homo sapiens
ggaaggtcatcctcataccttaactgtcagagtctgagaattttgtattcattggtagtttgaccagcctgtcaacttattcttgaagaaatcctcaagataaagtattaacattttttttctacctgatgatttttaggtaaagcagcagctttctctttttgctataataattccatgtaatgtatagtttttccccgactccccagctttttgagacatttgaaacagagaagctgaaaaaaaaactataatgaacttttgtatacccatacttatatatttttcctgaattatgtgaaaattatagatatcatggcagtt

SEQ ID NO: 336460 - DNA, 164 bp, Homo sapiens
ttttgttgttgttacaaaatcagtatgtcccatttagcagtcatagcttcgcatttaaaaaattgtcctctactctcatccagaccttttgtctggaagggatatattaaagcgggacaaaagttttcacagaatttttttttttttttttttttttttttttt

SEQ ID NO: 336461 - DNA, 240 bp, Homo sapiens
  misc_feature (215)..(215): n is a, c, g, or t
  misc_feature (217)..(217): n is a, c, g, or t
tgtccagccagccctcatgaagcaggctgtggctgtggagggcatggaggccctagggtgctgttcctggaaggttttagcaggagagtcctgaggcaatggagggtctctagggaacagcaggtattccctgagcctcagctaagtttcaggtgcctattgaaaaccttattccatagagtgtgagttagggggaagtgggggtgcaggagcangngcggtgatgggctgcctagaagg

SEQ ID NO: 336462 - DNA, 321 bp, Homo sapiens
cattaacgagatgtcttcctgttggccccgagaaatagcgaactgccatgttgtggagagggctacagagaaaggccctaagatcaacctctcagagctgagaggggtccctggccagcagccagtgggaaatagggggaagagggatctgggttgtgtaatcacaagaaatgaattctacaacaacctgagtgaatgtggaagagggctctgaatttcaaatgaggacccagctgactgacaccttgatttcacccctcacagacacccagctaaaaggtgctagactcctgatccatagaaactgtggagacagctaaa

SEQ ID NO: 336463 - DNA, 781 bp, Homo sapiens
ttaggattcagccctgatggaggctgaggaggcccagcgtggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggctctgaaagtgggactatcaggcagggggaagagctgccacctgaggagctgcaggaaagtcaagggctcttgcatccccaggaggtccaagttctggaggagcagggacagcaggaagcaggatttcggggggaaggaactctgagggaggatgtttgtgccgatgggcta

SEQ ID NO: 336464 - DNA, 156 bp, Homo sapiens
gcccggcttactgtcattgttttacagcacgtagtatcttcccgataaaggtttctcactcgtttttaaaatgctccacaaggtgacacatggtgttctcccagttctccgaagaaagctgcaggggcaaacttcgagggccttcaggaagccaca

SEQ ID NO: 336465 - DNA, 439 bp, Homo sapiens
ggtatggacacggagtcatctttgctgctaatgttggttttcaaacctagtaccagcatgttcgaggagcacgtggcttcctcctaacacgtggagtagtgtttcctccctggctcacagcctccactccccggagcctctctcgccctgcacgacccaggctctcagagctgctctcgtgctggcccccggtgctcgcagctggcatttatcgagggctcctctgtccacagcactgtggaaccaccctccatgcacgagtgagcgtgcacctcacaactatcctggcatgtgcattttacagccagaaaaccaaaagtccggacgaccagctgaccccagccctacgcctcaccacaaccccgcacatcacccacacgagcacaacgtccttcattcactctgcacatcccacacctcactacacccctgcacgcac

SEQ ID NO: 336466 - DNA, 238 bp, Homo sapiens
gtcccttctggcccgcacatgctatgactttatcaggcaaaactctcctggaatgtggcaggatgtggaaaccagtaccgagatcctgacctcctaaccttcctttctggctctcccatcatttgtttaccagagatctgggttttaggaaacgaaagcagcctcctgattcaaggttcagatcgtcccctcatccagccactgggacaggactttttatccaggcaagcacaggccg

SEQ ID NO: 336467 - DNA, 371 bp, Homo sapiens
atgcctcacaatgctgccaattccaccttgcacccctgactgatcaccagctagctgttctgcatatggagctgaaatctctctccagtggcttctccccactggtcctggttcccccgctcaaggatacgagaaattcgtttgatttctcatccccaggacaagctgctcactatcggaagttgatgtgcgcggagctttctctcatccaggcccagattccttccaccatcccatccccacatccaacaaagcagggggctatggtagcaagactggaaatggcgctgctctggatggggtggtcagggcagacttctaggaggaggtgacttctgagctgagactctaatgaagagaaggagctaggc

SEQ ID NO: 336468 - DNA, 283 bp, Homo sapiens
aataatagacttgtgatatgttaatataaacatttttatgaaaaataacttttccaaaacaaaaaaagtgagaagtgtggcattatctgacatttgtgtaaatcccattagtgtctggcttctcatagctggattctcataccctcttttttccattcagtctattgatactgcatatcatgtagcctctggacctcagccacatgcttaggagggaatgacagtaaacaggcaaatggtgacttggcatagtataaaaatagtcttgaccttgcagacccct

SEQ ID NO: 336469 - DNA, 349 bp, Homo sapiens
tcttgctctgtcgcctaggctggagtgcagtgggtgtgatcttggctcactgcaacctccacctcctgagttcaagcaattctcctgcctcagcctcccgagtagctgagattactgatgcacacacaccatacctggctaatttttgtatttttagtagagatggggtttcaccatgttggtcaggctgatctcgaactgctgacctcaggtgatccacccatctcagcctcccaaagtgctgcgattacaggcatgagctactgtgcccggcccagtatcatccattttttgccatgaggatacttccccgccccatccccaccaccaccccgtctgaggcaggaaa

SEQ ID NO: 336470 - DNA, 461 bp, Homo sapiens
aaatggaaatgatgacaatagcaccctgctcctaggtaagatgaggactaaatgagataagcagtttatgagtgttagtcatgtgtagtaagaagtttataaacactagggatgattgttcatttaaatatggctagaaaaggacattggacagacttgagaagaggctttgagtgtgaggctatattatctagtacgcaggaggaagccactggaaaaaaaacaagaaacagcaccttggccaagcagtgtttcagaaagtcatgacttctaacaggctctggcatccccagatgccatcaaccagcaaattataaatctgttactttgtggtttacgaattccatctttgtatatctacgtctttgataagcacagtcaagctgtacagtaggcagatgttgttaacccattttagaggtgaggaagcagaggccagggaactgggtgatttgcacaaa

SEQ ID NO: 336471 - DNA, 546 bp, Homo sapiens
ctgaatcctgccccagaacgtggctgtcactcaccataggattctcagcatagaatttttaattctgtaaacaccagccagtgccaaggagagcatgaggggagagaaagaaaacaagaaagcacaggtgttcacaatgccaagaagaaagatcaatgagatgaccaaacaagaggcactgtcttttctggctacctagtagggaggacaatgtagagtctctgaatagacagtggtcctacccacaggcacactcagtgactataagcttcctgagagcagggctgttctgaagagatttgagttttctcctggccatggagagtgtaattaagtagccctgggcccttgaagacttatagtgcaggttgactgaaagaactaaatcagccagtctttgcggagaggttgtcatgcaaacgaagtgctaagggtcttgcatgcatcccttcattttatcctcacaataggctgtgaagtaggcaccgtcatccctgttgtgcattgtgcaggcaagaacaccaccaaagcaaatgggaccaagac

SEQ ID NO: 336472 - DNA, 329 bp, Homo sapiens
tgctctctgaccctgatccagttccctctcctcctgctgctttagaagtgagggctcagtctcctgctcttgcttgttaggtcaaaagcttttagagacagccactgtcttctctatgggctctgagatgcttcttattctcttttggagaaaagacccccacagtcaagaagctttggctgagccatccttacttacagagcttgtgctgggcaagtcttggagggtcagcctgtgttctctaggggcttgctaacagaaaggaaacggcttttcctcgaaccacagagcacagcaactcttcagacacgctcggtcagcctgcaggg

SEQ ID NO: 336473 - DNA, 519 bp, Homo sapiens
tgttgctgtccctctctgcctcaaactaaatagtttcaccaaagcctaaaggctataagccaaatttatgaacatgactctctccttctccagctttatcatctctgggcattctccctcactccctcagatgaagaacggctggactgtatatatatgtacacagtatgtgtgtgtatttataccctttttttgtatttatgtttcacacacaaaaaaattattttggccgggcacggtggctcatgcctgtaatcccagcactttgggaggccaaggtgggtggatcatgaggtcaggaatttgagaccagcctggccaacatggtgaaaccccgtctctactaaaaatacaaaaattagctgggcgtggtggagcacgtctgtagtcccagctactcaggaggctgaggcaggagaatcgcttaaacccgggaggcggagcttgcagtgagccaaggtcgcgccactgcactccagcctgggcgacagaacaagactctgtctcaaaaaaaaaaaa

SEQ ID NO: 336474 - DNA, 337 bp, Homo sapiens
accagggagcttgctctctctttctccccttgtatgcacaaagaacaggtcatgtgagcatgcagggaaatggtgtcccttcccaatcagtccccactggggatcttcagtggcatcccagagctgtttgctatggtggcagtagctggagagctactgttaattaatttgagcaacagtgcagctgataaatttgatctagcagggaggtctgggactgccatcctgaactcaaggttctcaaatcctgtagctcttgggtcatattgataggggctatatttttaaaaagggatagttgggcagctggttggaaggaaatggcaatgagttcatc

SEQ ID NO: 336475 - DNA, 159 bp, Homo sapiens
atttatatataaatatgtgtatatatacacacatatacacacatataaaatttgcagatagaattatgtataatttgagaaaaatactttttatatgtctaaagttcaaaaacagaattatttcatgttaaacaatttattaggaagtgggaggatgca

SEQ ID NO: 336476 - DNA, 330 bp, Homo sapiens
tggcatgggcatgctgaataaattagtggcaatggattagtggatgggtcagaagctagatatgggtctgaaagggcagtgatatgtgaacaatggcaaaaaataacaaggaggtgaggtgagggaaaaccgacaaaaaataggaaaccatagacagagagagaaaagaatgaatgaagtgaagaatgcaattcagagaaaggggaactcttctacaagttgaatgttcaggggaggtagtaaaggcagacagaaaaggcggaagaagagggaaaggtggagaaggagcagcatatttttaaaaaggagagtgcaagagagaagcctcag

SEQ ID NO: 336477 - DNA, 322 bp, Homo sapiens
agatgaccagataaaatatcagtcaagcacatgtaacaaacacctttcattaaatacaaaatgactttgtagaggtcagctatcactgtcaccaaatgccatcaaatcttttggtcctaaaaacaatcacacagaaaagctaagatttcatcctttacaaaagcagggtcatcaccacactccttaaattctagctatccacaatgccaaacaacactggctcctttatcttcgcattcgaagtcaaggggtctaaggggctggcagaaattgctcagtcatgactgtaacaaaccatatctgttgtactttcctctaacag

SEQ ID NO: 336478 - DNA, 214 bp, Homo sapiens
tgggtcttgaaggcctttagagtctccaggagacctctgggtgggctgttgcctgacattgagcaatgtgtaccagagaaatggtgctgggcttgcctgggcagtggtatgggcaggagatctgggttccgagctggctttgtgagctgggttcacacgtagttgtgtgatctctggttgccctgcacttcctggagcggcctctgtggaaggg

SEQ ID NO: 336479 - DNA, 269 bp, Homo sapiens
agagtagcttcttacctgccagtgctagcttatgggcttaaaggagatggttcaaagaatttctggtaacagaaagataataggagcttgaaatacccctgttgacatcttgcgaataaacattgtgaaaaggtctttgatctctttgtcgttaagtcacttggaacatgcttttcttgtaaaaggttagttccagtgtccaaaacaaattttagctcatctgattaccttctgctgatgtaaatcccgtctagcatagcctgtatcct

SEQ ID NO: 336480 - DNA, 663 bp, Homo sapiens
aggaggattgctcgagcctaggagtttgagaccagcttgggcaacatagcgagaccccatctctattaaaaaaataaataataatttttaaatagatgttagccagtcttcagtcatcttaaggctttactggggctggaggatcctcttccaagatggtgtactcaaatggctggcaagttggtgttggttgttggtgggaggcctcaattcctcctctatgtgggactcttcacagggttgagtgtccttatgacatggcagctgcactccccagatcgagcgatgcaagaaaacaagacagaagcttcagtgccctttttgaccacgccttggaaatcatcccccatcactctcgccatgttctgttccttagacacaagccagtaaattccgcccacattcaagggaaggggagctaggtttcaccttttaaaaagaggtgtgtcagagaatctgggaacagattttacaaccaccacactgtcctaaagaggagtgatggtgtaattttgaaaaggaaaaaaagtctgggatccagacaaagattaatctggtagtaatgtcaaagatgaatggaagaaagggagaaacagaggtggatcgtagtgctgcgatctagcagtcaagtgatggatttagttggggcagtgagagggcaga

SEQ ID NO: 336481 - DNA, 539 bp, Homo sapiens
tacagaaagtaaggttcagagaagtagggacgtttgcttggggtggcacagctgttaagtggcagagccagacttgagcacaggtgtggtctccggtgagtctgcactgtgcaactcctcggattggccaacgtgagctttggattcatgctccagctctggcttgccggtggccctgggcaggttattcaaacttcctaggccttgggttcttcaccaatgatagtgacagtatcagctcccacccttagagttgtgagaattaaatacaatgctgtacttgagacactttgcgctgtgcctggcacatagtaggtgctcagcatgtcatggcctcagacacacagacagatgagaggcctggaagggtcacatgggcatcccaggaacaggggcacaatgccgggctgcgctatttgtgtcttagctcctggcctctctgggcgtctggctgttggctgaaggaaggagtgttagggcctggcttgccctgaagaggcaggcacaggggcatgggccttccaggagaatccaacctc

SEQ ID NO: 336482 - DNA, 179 bp, Homo sapiens
gtgaggtcatgctaagtcaaaaaggatcaggaaacagaaccatgaaaaggagcaaagatgaggttgtgcgagattgggcataaggggatgaatctaggggggcttagcagtcatcagtattcctacagcttatcatcatttacatgtttcttgatttttgttttgtttttgtttttttt

SEQ ID NO: 336483 - DNA, 2566 bp, Homo sapiens
aaagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336484 - DNA, 3590 bp, Homo sapiens
gctaggtggctgggtgaatcggacgaggctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336485 - DNA, 4266 bp, Homo sapiens
aaagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336486 - DNA, 3623 bp, Homo sapiens
gcggccgccaggggaaccgagcgcccggcgcggagagcgcgggagcggagcagtagcccgatccggggccgcgggccgagctgccgatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336487 - DNA, 3740 bp, Homo sapiens
ctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336488 - DNA, 2584 bp, Homo sapiens
ggaccacatggcaggacagcccggtgttatcgcgacatagctcttcgagggttatctcgtgtgctagaagcactcacttatggtgcactctccatagctggttgctcgtgccagttggtgtagtgcaccgtttgcagcgtccgccgtgctccctataggagatatcgtattaatgacgttaaacgcacaggctcagcgtgccttgatgctactcgacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336489 - DNA, 3115 bp, Homo sapiens
gctaggtggctgggtgaatcggacgaggctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaaca

SEQ ID NO: 336490 - DNA, 4198 bp, Homo sapiens
gctaggtggctgggtgaatcggacgaggctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaacccaggagtcctggccttgcttcccagaaccctctcagaaggccctctgctttgaaaaatagacaaaaggggcctctggccctccgtactgtggaagaccctcaaaggacagctgggctttctcagcacacttttgtcctgggagctgcgtggctggttgcccttgaattcccacacattgcctacttctgccagggacccagcaggccatttgctcttagcagagggcttgtctgccgggcacgtttgctgggctctctggtacccaaagtgcattgggctaggctggaggactgagctggagaaggcaaacacattcaggcccactcaacctagatttcctgagggccagctctgcaccagcacttctcagcacaggcctgcacccagcatgggtcggaccatgaacaagatagccttaccctttggaagcagacctgcttttccaaggctacctgctgagcagcccatgatgactgtgattggccctttt

SEQ ID NO: 336491 - DNA, 1483 bp, Homo sapiens
aaagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcga

SEQ ID NO: 336492 - DNA, 418 bp, Homo sapiens
atggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctc

SEQ ID NO: 336493 - DNA, 1165 bp, Homo sapiens
gcggccgccaggggaaccgagcgcccggcgcggagagcgcgggagcggagcagtagcccgatccggggccgcgggccgagctgccgcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaac

SEQ ID NO: 336494 - DNA, 3960 bp, Homo sapiens
atggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaagatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctga

SEQ ID NO: 336495 - DNA, 3712 bp, Homo sapiens
gctaggtggctgggtgaatcggacgaggctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaacccagga

SEQ ID NO: 336496 - DNA, 2928 bp, Homo sapiens
gctaggtggctgggtgaatcggacgaggctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctccctttcccctgtcccactctaggcaaccacagttgacctagaccagttccagtattccagtttgaccgtgttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggcttgaccaacggaacaagttaccctaaggataccgtgcattcctattctagagtccatatcaacaatagggtctacgacctcgatgttggatcaggacatcccgatggtgcagccgatattataggttcgtttgtccaacgatt

SEQ ID NO: 336497 - DNA, 1526 bp, Homo sapiens
aaagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaac

SEQ ID NO: 336498 - DNA, 124 bp, Homo sapiens
tgaatatcccacagtggaaagggttgaccggttggcggaaggcgcttgttgtgattcagttgggccacataatgaattctggtttgtttctgtaatagaaaatgcagccttcgctcttctatca

SEQ ID NO: 336499 - DNA, 198 bp, Homo sapiens
acggttcctgccctgatgagttaatgttataggggcagaggctgacaataagcaagtaacagaatcatggacacaatgattccaggtggtgatgtgtgttctgaggacagtgatgcagggtagcggtaggtagtgtgtgtctgtgcatgtgtgtgtaagtgtgtagatgtgtgtttatgtgcaaacttaagtgcagtt

SEQ ID NO: 336500 - DNA, 283 bp, Homo sapiens
agaaattaatgcagagaactcctagttgggcaatcagttccagactccacagaccccaggacacaaactctattcaagaatctgtttgtgatggttcagaagttttcaagcttgctttgggtacaaactgtatttccaacacttctagccctatatatacctgtcaatgatattatacttataaatacaaaagtccttattatggatgaagaaatagattaattaaaattgtatagattatatattagcatatgatattatacatcattataaaaacgaagaa

SEQ ID NO: 336501 - DNA, 203 bp, Homo sapiens
taggagagggagaggtgttttggaaatataaactaacctctttattgacagataggaattaagacttgagtttactttttcacctgtatagatttatcctcttgaaagggctgggtatcttctacagttgctgaagtttagaatagttaatgtttttgtgctgttttgcaaggaagtgtggacctgttggggggaaagaaggg

SEQ ID NO: 336502 - DNA, 537 bp, Homo sapiens
agggtgggtttttgtctttttggcccaagacagagatggtggatgaagcttctccttcaaatcttcaagatttaaagaaattgctccgcctctttgcctggaggaatgccgtgctgctcaaaacacacttttggacacggcacatttttctgtcacagtggaaagacctgactccctcaaaagggtgtttgcaaaaagcatcgcgttctcagaatgacaaaacagttttaaaagaaaaaaacattgtgtcagccctgcagcttatcaatataaaatgaagactaagattcatttatgtgaatggatcattttttgggggagggagttgttaaaaattcatatatcttggctaatggaaccacttccatatccacaatgaaaaaaattaaaaaggaggcttataaaacctttcctggaacaaccagaaaaggagtgagtccctgaaaatacaaattggtggtgttatctttgcatatttgcaaaattctttgaacttctgaatagtctgttgtggacctagtctgctgttactttgac

SEQ ID NO: 336503 - DNA, 419 bp, Homo sapiens
gaattagctagtcctgtgagggcagtctctcaaggatcaaggccccagatgccagagcatcaagaatatggaaaatcagagaacatgatcaatataccagctcatccctggatgaagctccctgcctttcctcatacagacaaaaaagtgcaatcctcaattttccggcctaccttgtagctgggagctataaaatgaagttcatcaggcatgagcggtctgctggtactgcttcttcccgcttccccttcttcttgctttgggatgggatgcgatgtttgctgctgtaacagccatttgcagccataaggaaaaggccaaatgaattgcagtggtgtccattgaaccaattctgtatttttctggacttcttgttttgtgagaaaaataaactgctatttaaaccactgtagtcagat

SEQ ID NO: 336504 - DNA, 617 bp, Homo sapiens
aacagcctggacaatggcatggagaggggaaggactcattgagactagctgttgtattgctgaagagttaagcctttattttatagatgtcagggatacagggaagaggtaaaacctagggatatggttcctggtctttggactagctgaaagcatttgggacacatagaacttcatatacagcagctcattctctttcttgagaatctatccagaatcatgttgcaggaaacatcaagccatcaaggggaggaaagatggagcaagaaacttgggggaagcagaagacagtccagtacacagtaaggaatggcatggagtaagagattcggaaccaggactctgaaaagttaggtaattttgcagttcctcctttgcatgggtttggcacagaaccaggcaatggtgacttaaaagtcatttagatctagatcataagtttccattgaaacagcctccagagtgcaggggactggatcaatgggggattgagctgggggaaggggaaaatgggaagccaaaagcggagaaattcagagaatcccctgcagtaacactgaagtatctgcagacagcagggtgtataatgatgcatgataaatagctgtttcctttcc

SEQ ID NO: 336505 - DNA, 1399 bp, Homo sapiens
atcaaattgctgcagccccttttgttgaaaagactatcctttcatcaatgaatttattttgcacctatgtcaaaagtgttatctgcctgaatattcatgaatgggagactactgagtaaattatgccaccaccacaaaattgactactatgaggtcattgaaagcagagtaagaggagaaggaggagctggaggaagaagaggaagagatggaggaggaggaggaaggaagagaaaggaggaagaataatatacatataaagttatctacacagaaaatacctgtgaaattggttttctctggggaaaggaactatctgggaaatgaggtggaaggaagattttcactacattcctttcagtgccttttgaatttcatatcacatgcatgtattacccatatgaaaaacagaataacttttaaaagttatagtgcccttcattttataatcacaggctattgacgcctgttcatggtgtttatcccttccatatcttgctttcttgattctcagaacaagaagacagtgggccaagtcctcaggacaagtgatgcttggttgttttaattgttgcctttttgtcaaaagcagaaaagcaggtgagaagttttgagccaccccaaagagaagtttgattctgctggtgctgtcaaagatgactgcaatgatagttttggccaaagctccaaaaagttccctgagagactcagagacttgtgtgtttgtggttgcaaggggttagcaaagggagccctgtatgatgagaactggccaccctaaaggttttaccttccaagtgcagcccatgcacaccaacagcatagagctgcagccaagacagtctgtgatgagcagattggagcaacactgtctggaattgatactctcaacagaaattcccttaatagtgtgggattccaaggagggaagaccccttttgttcagagtgataaatcaaggtgagctcttttatcccaatatatattaaattgtagtaatttctctttttcctgtcctgggtgttccacatcactaactgaagcaaggtgaatatccagttaactcagtccaacctaagaacactctgtcttccaaaataatcacttgagttcatctacaaaaggttgaaactttctaataaaagcaaatacaaagacctgctttaactaactgtgtgtgccttctcatagtttcctatgtcggattcccagagaaagcacataattcctccaaatgagttttctgatcacttaaaccaatggagcattccgttcctctcattacttgtcataatgaatattttcaaattaatgtatcacacagttaatatgtatgacattgttgttttcttatcaatttgctgtcaaactttgaaataaacagtcccataacagcaga

SEQ ID NO: 336506 - DNA, 120 bp, Homo sapiens
caagtattagaaaaggtttaattataccctctgggtaaagtaggtgaatgttttgtgactcaagcaaaagagaaataggctgagaaaatttgtagttgaatgtattcttttttttttttt

SEQ ID NO: 336507 - DNA, 259 bp, Homo sapiens
ctgactggatcacttatcccccgagtgcgcaccgcggggaagacagaaagctgaacctctttttttttctttttgaaccgtgtctttgacctttgtgttttttaagcagcagcttactttcctgagagatcttctagtgtttttagtggcctttagatgtttgacccttctctgtgtgtgagaacatggaagtaactttgtaagacacgagttttttctctcatttcctcattgttcttatatcttgtcacttaatctc

SEQ ID NO: 336508 - DNA, 353 bp, Homo sapiens
ccacaatcttcctctcccaagatgtgaactctccctctctgtgttcctttctctccatcagtatctcctggctatggtcatagcgtatttcagccgggccggcctcccctcctggcaataccaacgcattcatttcttcctggctctgtgagtggtttgctgcctcctatccgtcaatatccaatgccctgggacagcgggggaagtgggattccagcctttcatttattctttcacctatttgtcctctttactctgtgtacaaaaaagacaggattatagtctcaaaaaaaaaaaaaaaagaacaaaaaacaaaaggaaccatgaaccgctcctaaggggagaagaaaagg

SEQ ID NO: 336509 - DNA, 918 bp, Homo sapiens
aggtggagctagtgctgagtataggaagaccatgtagaaataccaaagtcagacccattggaggtttgagcagattgtgagattttcaggtacaccagggaggcaagatagtacatctctagtgctggacttaaactgaaggcagtccttctttaaattgttttggtgccctctgggcattaaacagatgcagtcttccacttatggccaatagttagagccacaaagagtctatttcaagtttcaggagatgaatggcatctctgctgctctttgagagactttaaggtatttttcccctgaattgtgattgggttcccaggcagggttcagaacattgtgtttattgtctgccgtattatcttttaagcaatgctgtactgcctgatggtatggaggaggtaacatagatgtttgtaaacatacagtcatttgatggctgaggaagttttgccacccagctagaagtaatttacgtattgttagctagaagaatttcaacctgaaattgacccaatttttcactctttaaaacagagcagttgctagaatagtgggtaggtttctagatttaacctggtttatcttacattttagttggtcaaaccttaatggctttttcaaagacttagagaaagtttaaaagcaatagtgactaaatagatggtggagcagaagggagcatggtttcatccacgagcctgagttttctttttgaattttcctctactaaattatatctttagttttggaatcatacgtcacatcaaattttagattagagatggtaaactgtttggcctgtgagccagatacggcttgcaggtatgtattttttggcctgcccagtttgttaaattctgaataaagccatcatttaaaaaccacaagttttaggcggggcgtggtggctcacag

SEQ ID NO: 336510 - DNA, 506 bp, Homo sapiens
gggtagtgcacttgccattagtccttttaagttgcaattcttcccaccactagaagtaatttacgtattgttagctagaagaatttcaacctgaaattgacccaatttttcactctttaaaacagagcagttgctagaatagtgggtaggtttctagatttaacctggtttatcttacattttagttggtcaaaccttaatggctttttcaaagacttagagaaagtttaaaagcaatagtgactaaatagatggtggagcagaagggagcatggtttcatccacgagcctgagttttctttttgaattttcctctactaaattatatctttagttttggaatcatacgtcacatcaaattttagattagagatggtaaactgtttggcctgtgagccagatacggcttgcaggtatgtattttttggcctgcccagtttgttaaattctgaataaagccatcatttaaaaaccacaagttttaggcggggcgtggtggctcacag

SEQ ID NO: 336511 - DNA, 721 bp, Homo sapiens
tggcccgagtgtgaaaaatgactcttcttttaaggactcgtaataaagcagaggtgacacagaacactcaaacaagacttttctaaaggttggcactaataaaagggaagtagacagaaagtaccattttagacaataggacaaaatcccttttgtcctccatgcctctgagcccaaagagagactctaggacccttctgtctcagctcccccatcaggggcataccaggggtccccaaaggccaaggagcacaagctcagagagacagcacactcaaggtctccacaccaaagctaagaagccgagccctcctgcttgcctgtctacgatctgtccttgcagttcttgttcctgtactcacagcggggctgccttacccgggcaggcctcaactgaacaccacagtcccacaaaagtcccccactgttcacaagacaatcacatggacagaaacaggaaaaacagatgtatttccttacactgaactagccccctgtctaattaatcctccatactccctccctccctccagaattgtttccttaaggcagatctcatctggtcacttctgaggaacagtggtgaaattgtttgttcctgacagcagacagccccattgcagagctctggtttcatgttacattaagtattagtgctgttctttcaggagctattatattgtgacatcaaagatttcactgacggcagtggcaatcgata

SEQ ID NO: 336512 - DNA, 421 bp, Homo sapiens
agatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgtt

SEQ ID NO: 336513 - DNA, 412 bp, Homo sapiens
tgagtgctgtgcttgttccagagctttctggggatcactgtgctcagtgcggtgagagacagaagaatggataattcaatcatgctgattgttcattatagtcagcagcaagcatttattgggaccattctgggtgctaaacagtggaactagagaaaggcacatgtcacagcctccagttctgagacgaaggatacaccacgatcatagcctccacttctgagatggatacaccatggagacaggcctgtggtgccgtgagcaagaggtgaactcagggtttgagtggtgtgggagtgactcccagcgctgctgcttcagagctgtggcaccctggacgtgccctctcagcccattttctagggaaactacttcctcatcagcacttcctctctacctggtggtgaggagg

SEQ ID NO: 336514 - DNA, 175 bp, Homo sapiens
tgtcttctctggtgggttaagtttgctgccagaacatgaggttttgtgggtggaggatgcaaatggggagtggacattgcacattgaagcccacacgtgcaggtgcaggccaccagggcagcccttgcttggaaatctgtcatctcaccttgccacactcacagccatttaggta

SEQ ID NO: 336515 - DNA, 443 bp, Homo sapiens
tcaagtttcgcccaagatgtaggggctgaagcagacaggaagatgagcactgctccaggaagcctcccaccagtgcagaagagctcttttctggaagacagggctggatgccacagtgaggcaagtccagccccagccctaggtcagtgtctttttttggttttgtgtctattcttaaggaggtgtaaagagctcttttctggaagacagggctggatgccacagtgaggcaagtccagccccagccctgggtcagtgtctttttttggttttgtgtctattcttaaggaggtgcttctggtacacaggcagtgccaaggccccctacaatgaagctacatggctacagggagttctgaaggttatagaagactatacagcctttgggatcttagctctgccatgcactcgctgtgtgttttgagcctgtgacttgacctctc

SEQ ID NO: 336516 - DNA, 247 bp, Homo sapiens
  misc_feature (10)..(10): n is a, c, g, or t
gttgaattantattataaatattttttttattttattatatttttttgtatgtcccgcctggtgaacagtaaccttccagaaagaggtaaagcagagcatgaagaggaagaagatgatataaagccctaaaatgtgcactcattgtattcaatagtttgttttaaaacaattatgaaatgacttgttttaactgaagttgagttgcttttgcataatcctagttgtgaataaaaagttttcaaaagc

SEQ ID NO: 336517 - DNA, 231 bp, Homo sapiens
ggtgtaggtgtgaatttttatatttagtgttttaaccacattttttgttttggtaaccttccagaaagaggtaaagcagagcatgaagaggaagaagatgatataaagccctaaaatgtgcactcattgtattcaatagtttgttttaaaacaattatgaaatgacttgttttaactgaagttgagttgcttttgcataatcctagttgtgaataaaaagttttcaaaagc

SEQ ID NO: 336518 - DNA, 389 bp, Homo sapiens
tcaggactcatgggcttcctctcactctccacctctctattgtcattccctctgagagtaggattcaatttaaggcacatgctccccacatggtgggaaaaacaaatgccagcagcccagactatatcttcagggcttgcaatccaaaggaagggagctctctctctcccagcatctatgtttcaaatctcagaggagaatgggattctcagacactaaatgggaagagataggatgtggctcctcttctgcttaaaacccttcactggagtcccaacatctacttacgccacaggataaaagccattgtgcacttaactccatggtgctacacaccattacctttgcacaagctcctctctctacagaaccctcatccccaacttgtc

SEQ ID NO: 336519 - DNA, 643 bp, Homo sapiens
cacagtggctcatacatgtaatcccagcactttgggaggctaaggcaggaggatcacttgaggctaggagctctagaccagcctgggcaacataatgagaccccatttcataaataagtaagtaagtaagtaaataaatgtgggatgcagcaaagcaggactaagagattaatttttagcattgaatgtatatgttaaaaaagaagaaaggtaaaattaatcatctaagcttttaatttaggaaaccagaaaatgaacaaattaaatccaaaggaagcagaagaaaacaacaaaaatcagagcaaaattgaaaacaggaaaacaaagaaaatcaacaagactcaaagctggttctatgcccttaaatttgataacttaggtgaaatggaccaatcccttaaaagacacaatctaccaaaattcacacaagaagaaacaaataatctgaataagcctaaatcaatttttaaaacctgaataaataattaataatcttccaaaacagaaagcaccacactcaagataattcattcgtgaattctatcaaatatttaaggaacagatgataccaatattctacaatctgtagaagcagagtgagcacttctaactcattctcagaggccaacattaccccgatcat

SEQ ID NO: 336520 - DNA, 1777 bp, Homo sapiens
gtaatatatatacatatatatataaatatttttttcttctttgtgataagtaaaccttacttatctgtcatactagggaatttctcgtgattcttaaccttttctcttgagcctttgttagataagtttagcatgccaaattccaaacagtaattaaaatggtagaactttggaactttttaaattctaaagctctcagctataaagttattgataaaatttcatacttcagttttcttctctgatctttaacaaacaacttttggtgcttcctctggcaaaacgctcctaacttcaatgaagtaaataacaaaactggcaattcatattttaatgtatagtttcaaataatttattatttcttttgcttccccaaataacccagctaggtgggtaaggcattaccccattttatatagagggagacattgaggtttagagatgttgactgagttgctgaagtttttgtggattatagcgatttgcctggaattgaatccaggtcatcagttcttagttaagtgttctttttcagtgaaccattaggtcattttatgacctaataagacgattgtggacacctaaggtttgggaaagctaaacctttactgaacttatttgcatatatttagaaataaattaagtatataatttgatttaattaattggtttccttgactttttctaatcacaaagtcgctttctataaattttaatgagtttatgtaacaaatgagtagaggcagaattggtttagagttgtatgctaggcttctcactgctgtgtagaaaagtggaaatgctggaatagactctttagaaaataaagcaggtcacagccagatggaggacccaaataattggccaagggggttaaagtttaaatataaacatagccacattaattttgttaagaaacactaatgtcgcttgagtgaagttgtaaaaacttaaatatacttcactgtatttaatgtcttgctgggttctgtggggattatatgtcatcgtggtctctgtcttcaatcaatctgaagtttcattggggagataaatctcacatgaaataaatagcagtatgcatgatatactctgtggtggaatgccaaaatgacagtaccgtatcaaacataaatactctagcagtgtgagaaccaaagacttagagaaggaaagggtttatggaggatgggcattggtttttgttaggtattataaatgtacaagtttcctaaagcttattaaattttgaagccattatttgcaaatgtgacatttactaattttaagtgtaaaataattgaagattagatctgaagattagtcaccaagcaactttaaggagtgacctcttctttattgcattatagtaatcttttacacaaaagaagaaaactaagggttttcaattttactccttgttttgcttatttaattcattgtaagccccctaaaggctcattctaacaaaaaagaatatgatactagactgggcatggtggctcacacctgtaatcccagcactttgggaggccgaggcaggcggatcacaaggtcaggagatcgagactatcctgactaacacagtgaaaccccgtctctactaaaaaatacagaaaacaaaaaattagccgggcgtggtggcaggtgcctgtagtcccagctactcgggaggctgaggcgagagagtggcgtgaacccgggaggcagagcttgcagtgagccgagatcacaccactgcactccagcctgggcaacagagcgagactccgtctca

SEQ ID NO: 336521 - DNA, 386 bp, Homo sapiens
ggaggcggggtccactggggaagaagtggggcagggcagggaggcaggaactctgctccaccgagatttatttgggggaaactttcctcggttaatcccttggaaaagaccatccaagctgtcttgtcctagcgcagaatctttctttagaaaatgacactgaaattatttgaaacataagttgcaaagaactacctcttttttggagcaagagactttgtaactaaactttcattggtaaggaaggttaatacctgtttcaagttgtttctgtaccaacagctcagggagggcatcaacagaaatttgcaagaaggattccagggcaagtgcttcattacagctgcacactgtgcaggtactgctcagctcagtcgaacggactg

SEQ ID NO: 336522 - DNA, 743 bp, Homo sapiens
tgggatgtgtggctactccagtaataatacctgggcatcgaagttcagttcaagtccagggccggggcagacttctccatctgtgccatccttctcccttcttccctgcatcctttcttctctctgccccttcctgaggcaccattcccctcagtgtctgataaaatgtcagcctccaccccagttgataatttttatatagaaaaaacatctgaaaacgtggagttggaagactcaggatgtcaactgtcagtgacttggctttgaataggcctttttatcactccgagctttggttttctcatctgcagtatggggataacattcctaactttatgggttttgctgggcagatcaaacaaaagaatttacatgaaaatgattcatgactaatgaagggttaatacaaatgtaaattattattaataagattatagaggggtcttggacaaagcaacccaatgaacgactttatagtgggagaatttctagcttcaggggaagagacattttggaagaggttggttggtcttttctggggccccaactcttatcatgggggcattcatccatgtaaataattgaccttcaggtagagtggattgtggagacagacctgctcaagtttgaatctgttctctgcctacttgtgtgatcttgggcaagatttttaacttctctgggtcttggggttactcatctgtataatgggggaccaataaacctgtaatttagggtcttgg

SEQ ID NO: 336523 - DNA, 149 bp, Homo sapiens
ctcatgcaccactgtctagacctgcacccactgttcagaatggcagccatgagccacgtgtggcaactgggtactcaagtgaggcagccgtgaattgagatgtgctatgaaagtaaaatacacctgctattgaaacttctaaaactagg

SEQ ID NO: 336524 - DNA, 702 bp, Homo sapiens
accaaccaaacaaacaacaacaacaacaaataaagactcatttcctggaagcctctgatttaactcgtggagatcattcccttctccaaattgtggcccttaccatagagttatttatttgtgactaaactatgtcatcttgcattgttatctgttttcacacagtctcttacagcccaagtagactgtaagcctcttgagatcagagataatttacatttctttatatttttcagaattcaccatctttccctttggccttcccacattcctgtacactctcgacattccctggttatctggcagttcatattggggaattatggttagctgtggatcaggcctcctctccccactttcctctcagtaatgcatgtagtctctgagggcagacactacattctcctgtgtcttttctggtttattcaatgatagaggctgtaccctttatccttttcaatttcatctacattcttttccttctcctgctcagttcttggaactcccatttctgagtgtctacgactacagtcatggtgaatagaaggtaatgaaactgtgagtcagtgtatcctctagctggagtgtgaaggtgagtcagcagacagcagcagtggatctcttccaccctgaggaaaggcaggagcctgcctggtgatcagggaaggaggccctcctccccacattgtttcctggaactga

SEQ ID NO: 336525 - DNA, 394 bp, Homo sapiens
tgtgggaggaggagggggtgtcctggtctaggggatgtgccatgaagatggctccatcatggagtgactgtagtcttcatggcccaagtctgtagccacctctggtgggtgtcactctagataggatggagatgtgcctgatggagtctttggaaataacagccaacagaacagctggggggtggagaatgggtatcagtgagctctgggggcctggttcagtgtacaaacttaaggagacgaatgcacgtgaaaggtcacaacccctgcagagatgtctggtcacttatgtgtatgtgtgtaactgagggattgtggggaggctggcagcatgtgtacatgcttgtgtgttgttaagtgtagacacgtgcatgtgtgtggggtgcatgtgagc

SEQ ID NO: 336526 - DNA, 526 bp, Homo sapiens
ctcagcctcccaagtaactgggaccgctggcacacaccctataaggtggacaccaccacacctggttaatttattttttgtagataaagggttttgccatgttgcccaagctggtctcaaactcctgggctcaagcaatcctcccaactcggcctcccaaagtgctaggattatagataggcatgagccaccatgtccagcctttacaaattttttgcagataatctcttctttccattcctattgctgcttaccccagttcaggccttcaaaaactttcacttggtctattatcaatagcctcctggctgatgtccccaatgacagttcctcataaatacagctacaaggtttatcttcccaaagcataattctagtcttgccactctccttgctcaaaaacattaaatgtctccccgtagccttccaactagatagagcataaattccttagcttagtatccaaggccagctcctttcatttgtaccctaatccaaaacattttttgagtcatacttaggttag

SEQ ID NO: 336527 - DNA, 481 bp, Homo sapiens
cagtgcattatggccaggatcaaatgccacctccttaataaactcatccctgattcctcattgtgaattttccttccagtaaatgacatatttgcaattttttcacattagcttaaaacattgttttcacatttacaaatttgtatacttagacaatgaggcagaaaactagacttcatttttaaattcccagtggtaacttgcagaccatcttggacacagtcaaaaagtttagaaggcgaaaagaaataattgtgggggcttatatgtgttttactctctttctcatatgctttatggtttatttggtgctttttggatagtcaatttatatatactttcattacaattaatgttatatttaggtattattattctttctttacacttaaaaatcatggcacataccccagactgtacatagtaagtgaacagagctgggattaatatctagatccacctccaaatttcttttacttcc

SEQ ID NO: 336528 - DNA, 289 bp, Homo sapiens
gtcttggccctcagacaactttcctgtgtttgattaagacagctagagaagggctctgccgtggaccctggcagttttgcttgacttgaatgtgtgtgacagttatttaatttgttcatcattaggatggcctcagatttgcaatcagaccttgtagacactgagtcatgtattctgggcaggagatgactttgccgattactacctccccagcagtcatgaaaaaaagataccaccccagtggttgaaatcacaaattgaaatacctgattccaagaagtcaggtatg

SEQ ID NO: 336529 - DNA, 472 bp, Homo sapiens
ctcccatcagaacagacagtaaagacaggaatggcatgtctccagttgtggggcaaggcccctcctagtgtgaagaaaatatacttcctggatctatcattatctctagcatatcagaggggggaataaaaacaactggggtggcaaggccctgctgaaagagaaactcattgttctgcacattcagagacttcctagttgtaaagccgttcagagctcttggaggtgaaggggcagccagggaatcacatagagtgaaagacctgtgtgcagcggccaggtcagagggcgtgtagaagacgacatgaagcattcccacagggcagttccctgaggttctgtcctccagctcttgctgcaaggaattctagaagccttggcctgatgtgtgggaaaggaaaacaaggtgaagaggatgcaggtaggaaaagaagagctgtgacaaggtagtcagatgggaggactgcatgag

SEQ ID NO: 336530 - DNA, 184 bp, Homo sapiens
attggcagatccagaaccaagactgtgtttttctctttgattctggatctgcattagtaaggaaggatgagattcacaagctgacagttccaattttttccctttattagaaatgtaatagttgttcatttacaaaatacagaaaaagggccgggtgtggtggctcacgtctataatcccagca

SEQ ID NO: 336531 - DNA, 328 bp, Homo sapiens
cttctcacacaaacatatcacatttaatcacacattctgacacaatcatacacatacatatgtgcatgcgtgcgtgcatgtagtgcacattcacacgggcacacacaccgcctctactactcgcacctctccatctcttcaggagggttcaggcagggttcattggtgaaatggcttccctagttctattggatcctcatcctctcctggtatttttgtggacccatacagcaatgacaagtgaggtttaattctgccctgtcccatctccaatagttgcctgtagcactgttgaggatttgcaggctgcatctgggctcttcaggaa

SEQ ID NO: 336532 - DNA, 248 bp, Homo sapiens
tattttcttaccatcaagaaattacaatggtcacatacttagtaactgccacataaatactgtttgcttgtaaatacgtgaacttccccctctgaatttttagcatagaaatacaacataaactacatgggttggccacatactcctggaatctggaaatatgtgagaggaaaatttgataaattattttatgcaagcaaaacaaaagcgctggttgctccagaatactttagatgtcgcgaaaggag

SEQ ID NO: 336533 - DNA, 474 bp, Homo sapiens
gctgggatctcttattttgaaactcaccacaaccatttggtcagagtgcttcactggcctccactctgactgctgccgaggggctgatcagaagacaatgagattgcaacagcttctaccagttgtatgctgacaaaatgggtaggaaagcttcctttttccaacagataacagcattggaaacagaactgaaatgcactgtgtcatctcatctccccaagacaagactgtaatgttccaaagcctccttgctcacagaaaggatgtaacagcagatatgtacggaaacataaggatcctaggcatccgggatgcctggccactggtctggtcactcttccttagacctctttaaatcagtacatttcctgagcttggatgggtttgtctattagtgtttcccaaagaacaccaattatgaaagaggtttcagacctgttctcaatagggaggttacttgttaccgattctcta

SEQ ID NO: 336534 - DNA, 161 bp, Homo sapiens
ccaactccataggaaactcctcttcaaaacagtgaaggaaaagaacaagggaaatttataatctttttttcgtgggtgtatatcagcctatgtttttgacaagcagtaatgggaaataggtttcctgcatgcttctataatattttccttgctgttggttt

SEQ ID NO: 336535 - DNA, 370 bp, Homo sapiens
ctattttactcttctatgataatcaacatatgtttatttaatgcctgctctctgtgaggcttaatactttgacagacaaaaagatgaatgaattcaagttttcttctctagaagcttatcatataatgtggaggtaatacctacgtagaaataagaggaaaggaaacttattacatgtgggaaatgaaaccttttgagctgtgcttcaaaggcgatgtaagacttggatctgtagagataaagaagataaagaagaggatggaaatggtagaaaagagagaacaggatgtgcaaaggcatggaagtagattagtgaagagaaaaataattcatttggtaagagattccggtacaaaagagaagcaaaggg

SEQ ID NO: 336536 - DNA, 180 bp, Homo sapiens
ctcccaaagtgctgggatcataggcatgagccaccacacccggccaggatgccagttctttatcagatatgtgtttcgcaaatatgtcctcccagtttgtggctgcttgttttcttttcctagtagtggatgttcgcttttggacgagtttggaccagtgatcctccaggatgtcccaca

SEQ ID NO: 336537 - DNA, 973 bp, Homo sapiens
gcggggtgtgctcgggaattcgtggtgcggttcagacaggtgtgcttctgtaacaggtcttccacaccaagtaagtgtttgccatagtcttgagacaatactagcaccttcatttcatccatccagtccataatgtagagcatttcctggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagggtctcactctgtcacccagactggagtgcagtggcatgatcatggctcactgcagtctctgccttataggctcaagtgatcctcacacatcatcttcttgattagctgggactacagacacttgccaccacgctggagtaatttttgtaaagatgggttttctccatgttgtctaggctggtcttgaactcctgggctcaagcattctgcccgctttggcctcccaaagcgctgggattacaggtgtgagccaccacacctggtctgctttatgtaccattaatcataaatacaaatcatcttgcttacagttacttcttaaagtaaatgtattaatatatgttagagtgcattataaacttttaaatggctacatatttagtaatgacaacaaccaggttgtatgtgctcatacatttaacttaaaaaataaataaataaataaaaacttccaaaagaatatcaag

SEQ ID NO: 336538 - DNA, 681 bp, Homo sapiens
atttagttgatctgattacttaattgccatttcagttttccattttgcttttttcactccttcacaattgggtttgaaactttataaatttcattcttttatcacggtttatacagaatttgagagatttcaggttaatatagtttcagtgatgaggactgttttacttgagatacattgctgtttcctgaaattttctcagaagggctatgttgtgaagaatttacaaatctgataacatttttccatcattaaaatttgaaacttgcatcaaacacctctttttttttttaaaggtggattttgcaaatcgggaaagtcagctggctttttatcactgcatggagaaatctggtcaagacatcagagacttttatgaaatgttagccgaaagaaggtatgtattttaaacttaccagtgtagcttgagttttaatagttttaatacagaaacttaagatggcattaaattttatttttcactctttacccctactttcatcttctagaatagagaatgcttctcttttatcacttcatatggaaacacaggtttatttttttgaatctagtttccaggtaattcctatgggtttggagcaacctgtctggatttctcactgaatgctcctagaacttgaaagagttactgttttgccaggtgataactttatgtacttt

SEQ ID NO: 336539 - DNA, 12946 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336540 - DNA, 11397 bp, Homo sapiens
gcggggtgtgctcgggaattcgtggtgcggttcagacaggtgtgcttctgtaacaggtcttccacaccaagtaagtgtttgccatagtcttgagacaatactagcaccttcatttcatccatccagtccataatgtagagcatttcctggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336541 - DNA, 12889 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336542 - DNA, 11163 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336543 - DNA, 11884 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagtacatgcaagacagggatactctagagtcagctctgac

SEQ ID NO: 336544 - DNA, 7660 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctcaggctgggcttctggcccagcctgtggggattttctcttagaggaagttattctgaggagtcagaacgcagcacaagataaactgcttgccaatttagttttctgttgctgtgtgatgaactgccacacacttagcagcttaaaccaacgcccgtttactctctcctagtgatggagttcaaaagtctgggtgggctctctgggttctctgctcagggtctcagcaggctgcgttc

SEQ ID NO: 336545 - DNA, 2560 bp, Homo sapiens
ttcatgattacgccaagcttggcacgaggcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336546 - DNA, 1996 bp, Homo sapiens
gttttctgacacctgctaggtcttccagtagacatagtcctggcacatttgctggttggggactgatttggcctggctcttagcattgggcctcttcagggctccccaatggaagtggagttgtgggggtgaagacagacggtcccactttgctctctatcctgtctccagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtatccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336547 - DNA, 1408 bp, Homo sapiens
acagcctgtcttcactgggcaaaagtccaagtcactaatttagtgcaaaggcagtgctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336548 - DNA, 1115 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatgggtaagttccaaggtttctgtaggcaggtattttgtatttgatatggtgagaaacagaaactcatatttaggggccccagatggatttaaagttttgggcattctcaatgtttcctattttgggttggaaacggaagtgatttatatcccaatggctggtatcttatggaatcgtagaggatatttcctgcagctgattggatatctgttcctgagatataatgtgatggaagatttcctatggaagcttcatttttggagttacctgtcttctagaattacttattccttctcttggataatgttaagtccttccttggatatatcccttctacctgatggagctatttggcttttgtgttcatactatatggaatatttctggaatattagagcctacagattcttttagaagttgatatctgcctctccattttcactacataaagtgtacaaacaaattggattgtaacaaaaaatggaaatgtgtacttggatgaagaagaga

SEQ ID NO: 336549 - DNA, 634 bp, Homo sapiens
cacccttgcccattaagaaggtggattacccccataagaggggccaaaattggggaagttatgttcacaattctctccctagatttaattgggattataggtcgtgtttccacacttggaaaagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacaggtaggttaacagccttttgttataacagatgag

SEQ ID NO: 336550 - DNA, 12423 bp, Homo sapiens
  misc_feature (12249)..(12251): n is a, c, g, or t
  misc_feature (12267)..(12267): n is a, c, g, or t
  misc_feature (12272)..(12273): n is a, c, g, or t
  misc_feature (12297)..(12297): n is a, c, g, or t
  misc_feature (12320)..(12320): n is a, c, g, or t
  misc_feature (12335)..(12335): n is a, c, g, or t
  misc_feature (12358)..(12358): n is a, c, g, or t
  misc_feature (12418)..(12418): n is a, c, g, or t
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacccaaaaaaaaaaaaaaaaaaaaannnccccccccccccctcnccccnnaaaaaaaaaaaaaaaaaaaaaaanaaataaaataaaataataaaaantccctctcccccccnctccccttttccctcttctcccntcctcctcccccccccccctttctcgtttgggggtccccttttttctcttttcccccctnaatta

SEQ ID NO: 336551 - DNA, 11052 bp, Homo sapiens
ctgggtgatccaaggatccctaggtcttagggaggaaaatcgttgtgaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336552 - DNA, 12782 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctcgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336553 - DNA, 11306 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaaccagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccgaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagcctgggtgacagagagagagtcttgtctcaaaaaaaaaa

SEQ ID NO: 336554 - DNA, 2390 bp, Homo sapiens
caaacaggaagcgagctcatggcccctcgctgagccatgctggacacagccagaggctgtagcttgtgggtctgttaactagggaatcttaggacatttgacatggcataaaacttgggggccaggaagggcagcccctgctcatgcttacctgcagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336555 - DNA, 2173 bp, Homo sapiens
ttcattcaaatatcagggtagcctttaaagtcatctcagaggtgggggtttttgtggacctgatactgtgggttggatgtgggctgctgtttgactaggaggcccctgctcactggcagctggcctctgcctcaggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336556 - DNA, 1592 bp, Homo sapiens
ctgccgcggtaaggggggtggtaggtgcggctgtcgctagcggtactcttgaaacagcgcccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctggggccctgggggctcatttgatcccgtctctgcctccagacaggagaatgggagttggggacaggcttcccctgcagctggattctctagaagctgtggagttgggacagggacatggggactataaagttggtggtctcacttggaataccaatgggctcctacaaatgggcctgtcctggtgtgagaagatagcatccccctctgaacggtgggccatagatgccggggccactgtggggggacgagatggtacctcctgactccttgctgacaggagtgagaaagctgttcc

SEQ ID NO: 336557 - DNA, 330 bp, Homo sapiens
tgctccacctgctccataatccactctcatcattgtgtagcaatgtttctaaaacacctgccaaaacatgttacttccagtggcttcccaatgccccttagaatataattcaggtttcttaacttggcctacaatctgccttcctctccagattcaattctcaccatcttcttcccaaatctttaagctcagtgattctcaaagcatggtccctgggccagcagcatcagcatcacctgcaaacttgttagagatgcaaattctcaagccccaccccaaatctaacaaatctcaaactctgggtctaggactcagcaatctctcttttaa

SEQ ID NO: 336558 - DNA, 711 bp, Homo sapiens
gacaaatgtatgccttgaaacgcgcaatgtgtttttattctgtggatgtaccaaatagcccttcttggaaatgatcgggggaattcaaataggcagaaatcctctggtcagcacaaactacaagctagcaattctcaagacagcatgagctgttttttagtgtcagctatggtcagaagcgtgtgttgtggcatttggaaaaggaattagggcagttagctaattgcacgcttgaaaatgagaagctctttgaaaattcaaaagtctgattccagttcaaaaagaaattggtgttgctttgaactccaaagttgttattgtatactgaatttcaagtacttcctactaaacatggaaaatttgctttccccccaaccttatcctgagtgtattgctattcttagcccatgttttgaagtgttcttgatttaaaagatggagagaatgggttatatcagttccattaatttaataaacagccttgctttgcggtgtaagtattttccatctatattctgcagtagtgtttggggtagattgtgagctttctaatcaggggccatgagtcaaggaatagcctattgaccagttagtcttggaggtttcaggaatccttaacactttatgatggatcaactagggtactttccccatattttctttatacagagttaacaaaaatctggagattttttttttcttttttgatac

SEQ ID NO: 336559 - DNA, 175 bp, Homo sapiens
  misc_feature (155)..(155): n is a, c, g, or t
ataagatagaaaatatgaaagacaaattaaaagacatgaaaaacagaatgaaaatcccaaacatatacctaacagttctaggaaaagaaaagtggtctctgaatgaagccatgagaccttattattttttttaaaaaaacagaaagtgcctaagntatttcctctgtgtagctgt

SEQ ID NO: 336560 - DNA, 325 bp, Homo sapiens
aacacactgcttccttcatcaagaaaaatgtcagttgtactaaatagtatagttaccaatgtagttaaataacattctggtacaacctcattttgtcatggaccaataaaacttgcaaacaattggtgtaatagcaagcagctggtctgcatacaaaattaggcagcactttgtacaacagaagttaacagacccatggtagattaaaaatgtttaacagtgttttaaaactgaaaagggactgctaatgtagaatatccaaggaactcttccagatcaacaaggatgagcaaaggatatggataggcaatttatagaacaggaa

SEQ ID NO: 336561 - DNA, 188 bp, Homo sapiens
atgaacaaagtttcttggagacctgaaatttcttcccatttctcttccttctcgtttcttcttatgattaaaatataaatattgaaataacgtgccttccctaatatcagtggattcgttcaacttgatatagctgaaaaaactttctcatttaaaaaagccctttcaggcagttttagcagttaacg

SEQ ID NO: 336562 - DNA, 298 bp, Homo sapiens
ggcttgatttaaaacagtgctgttggagatggagaggagataccaaattctggagacatttctgagttagaatctacagtatttatcagacaagggaaagattagacaaaggagttaagaatgactcccaggtttcagtttggggcaggtaactaggacatgttttgaaaagtaatgtattagatctcttaccattggaactatgtatgtggagccaaattaaaatttgtacatgtatataactctccccccaccaccagtaactacttccctaactctctactttgtagccagactt

SEQ ID NO: 336563 - DNA, 145 bp, Homo sapiens
caccgctcctggccctgagactgggtaatttataaaagaagtttatttgcctcatagttctgcaggctgtacaagcatctgctaggcttctggtgaagcgtcaggaagcttttactcctggcgggaggcaaagagggagcagacg

SEQ ID NO: 336564 - DNA, 279 bp, Homo sapiens
tcccctgatgagagtacccggttgtgggtggcaaccctgggcatgtaccaccatccctaccccgcccctagcacactctgctttaggggtggctctctgggtccttgaagctccctggtgcttgtgccaaagctgacctggatttgaccttatcccagaagtccttcctggcaaccagagcttaccaaggccattgcttgctaagcactatatgaggcctagatgaaaaaggcctttctaggaggggtttgtagtttagttggggagacgagactgtag

SEQ ID NO: 336565 - DNA, 269 bp, Homo sapiens
aatgttattttcaaaatgtatactggatgttgacctgtcactgatttcccgttgcatttggaatccaaactccttaccatgacccaaaagaaagcagcctctctccaacctcatcttatccagtctttccctagatcattagatgccagcccaatagccttctctcagttcctagaacaaggccagttactttgctcttaagaggccttcatgaggctcctccctctttagaaatactcctgttgcttgttatcttccctgaccctcac

SEQ ID NO: 336566 - DNA, 234 bp, Homo sapiens
aacatttcccaatcattctgcaaaatcattagctttctttccctcaacaaaatggtgatgaaataattttgaactcagatttttaagattacagaacatagaacgtaatgcttccaggcagggtagcttgtagcagaattacatcctgccaaaaacaatgagaaagggaagattaaaaagaatgcgtttaggccaggcgcagtggctcacgcctgttatcccaacactttggga

SEQ ID NO: 336567 - DNA, 351 bp, Homo sapiens
ggtgcaattcagaagacttagaaaatacagtaattgaaaatgtattgactttgtaataacgaagaagttattagcattttaaagagagaaaagagttataaagaatacttagcatgtacactgaaagctttaaagtcttttcatttgtttctcctaattgccttatgacagtgaaaacagctgtattcctgttacatgggaggtcaaacatgatcaattctaaagcagactctacattgtggctaactttggtggcacttacagtggtcactgaatccagacttcaaaaaaatacattaatattatatgttagaattttctaaagggaaaagaaatgtatgtaaggatcca

SEQ ID NO: 336568 - DNA, 907 bp, Homo sapiens
gtaagtgtatctgtggaagagtggtgaatgttcaaagtggtttacattgaaacgttactttcctcttaagtttctcttctggggttataaatgactgcagatcctccctactgtcttgctgaagcccctcacgcccctggtttgaattcttctccaatcttataaacctcttacaggttattctaacatttttatatctgggggagcttctgcttgtcccataacaaaccctcatttacagcagtgggactggtagctaagttgaggtttgatacatgtttttacttttacttttctttaggttactttgcatcagcagactgcaaactttttcttaaagagccagataggaaatagtccaatcctgaagtgggccatgtggcaatacgtaagcaaataggcctgctgtgtttcaataaaactttatttaataaaacaggtggtgggctgagctgctttgtataatcttaggtaccttgaatccatagtccaaggatggtagaaagacaagagagagaaggaattgggcccggaagtaaaggcttgttaaataggttcattcttttttttttttctcaacaaattctgagcaactgccttttttcaagaattggtctcagcacaatggttaaactggtgattaaacagatgagtccctgctttatgaaatttacattttctacctagtgtacattgttcactaaccctaacatgagtcagaaataacatgtaataaagaatggcttggttatatgcattttctcaaaaggagatacatagaaaacacttaaaagagcccaacctaaaaatctgttacctaaagtaagacatcccataattttcttcaaatcagtggttctcagccttgattctacattaaaagcacctggtaagatttaaaaaaaaa

SEQ ID NO: 336569 - DNA, 1444 bp, Homo sapiens
taccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagctttt

SEQ ID NO: 336570 - DNA, 2502 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336571 - DNA, 2693 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagaaaaaaaaacagaacacaagacgcaacacaacacccacacaggagcaacaccacccacaaacacattgggcggcgccccccgaaataacaaccgggggggcgcccacgaagaaaaagggccggccaagaacggcgcaggggggtccaaaaaagggcgcggggaaaacgggggggggcagcggacacccgcgg

SEQ ID NO: 336572 - DNA, 2448 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccatttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336573 - DNA, 2442 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336574 - DNA, 2473 bp, Homo sapiens
ctcactaaaatgacagcatacaactggtttatgaaattattagatctgctgaagggctgagaggcgcacccgggcggccagctgggctcggagcggaacggggtcaggatggacgaggacgtgctaaccaccctgaagatccctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336575 - DNA, 2741 bp, Homo sapiens
acccgcgcctgcctggttcccggcctttgccaggcccaagttctctgggtcgctctccctcctgtagcgccgagaaaacaccattccgagggccgccgctcggccggcagtcggctgtgaaagaactggatcttgtgactgctggaaaatttcgctttagtgtaaggtccgagtgcttcagccgtgggccacctttgaaaataaaatgtaattgttatttctcattttgccacatcctgtggagacagaagattagtgttgtgctttcattttttactttttccttggggaaaataatattgacagtggagttgagtataagcctgctcttgaggttcacagatgatacgtttgatccagaacttgcagcaacaataggtgttgactttaaggtgaaaacaatttcagtggatggaaataaggctaaacttgcaatatgggttactttgcatcagcagactgcaaactttttcttaaagagccagataggaaatagtccaatcctgaagtgggccatgtggcaatacgatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336576 - DNA, 2446 bp, Homo sapiens
ctcactaaaatgacagcatacaactggtttatgaaattattagatctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336577 - DNA, 2448 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336578 - DNA, 1446 bp, Homo sapiens
cccttatgttcggacccaccagcagtttcaataccaagggacagaggagtgacatccacagagcagcaaatcttgaacattctcagacttgtctccagacaagatggctgcctggacagctgcaccataagcaacctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336579 - DNA, 1106 bp, Homo sapiens
tgaagaactccactgttttcaagttaaaggtcacctcgtaggccaggcgcagtggctcatgcctgtaatctcagcctcccaaagtgctaggattacaggtgtgagccaccacgcccagcccacacatgagttttaaacataaaaacaattacttaatggccttgtgaaaattagtgttttatgaaaattggtattttaccccacagtaaaatagtagtaaggaaagtgtattgttaccttttagtaacttagtgagacacttaagtttctgtcttgcataaaatactcttttaagataattgttggatttgggatttgcagatggtactataaagttagcattcttctttcttggcaattagctaaaaacaacaaagagagggaaaaactgacacacaaacccagcattccactaaactagaagacagttaaaaaccccaagccacaaaataggtggaaatgttgccaggagcagtggccatcaggctggctgcatgtgggaagaagtaggtaggatgccgtggctgtggagctcagagacaacaagaaacacccatgaaactgcaaggcccccctgaggtataaaacctaaaccccttgtttacaaaagtgaagtgggtttcttcagctcaaggcaggagctttcctgcacctggtttaattctaagaagtcggggaaatgaagccaaacaaggagtcacataaacaagccatttttgcaggaagtaatatgtgtctatctctatagcagttggggaggagatgactgcattgtgaaaaacctccagactgcctgtctgcattggctgttgagaagtaaaatgctaaactgtctcttaggtaaatctctgaatcacgaaaaagttgtcagtccagaactggaggcactctggccttctgcataaacctcctacaaatatcaggttctggacaaccagcacttcttcagagatgaataatcaaaaggaattcattaagcttgactgccacaaatgtttggaaataaaaaaggaagaaagaaacagaaaaacaaaggacagatgaaaatagaagtaagtactggtatggagcatcgacatgttcggggtcctctagagtcgcccgag

SEQ ID NO: 336580 - DNA, 837 bp, Homo sapiens
taccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacggggtcaggatggacgaggacgtgctaaccaccctgaagatcctcatcatcggcgagagtggggtgggcaagtccagcctgctcttgaggttcacagatgatacgtttgatccagaacttgcagcaacaatagcagttggggaggagatgactgcattgtgaaaaacctccagactgcctgtctgcattggctgttgagaagtaaaatgctaaactgtctcttaggtaaatctctgaatcacgaaaaagttgtcagtccagaactggaggcactctggccttctgcataaacctcctacaaatatcaggttctggacaaccagcacttcttcagagatgaataatcaaaaggaattcattaagcttgactgccacaaatgtttggaaataaaaaaggaagaaagaaacagaaaaacaaaggacagatgaaaatagaagtaagtactggtatggagcatcgacatgttcggggtcctctagagtcgcccgag

SEQ ID NO: 336581 - DNA, 593 bp, Homo sapiens
gtaagtgtttactttaatgtactatttaaaaatatttattggagtttctgattgtcctagtctgtgaaagttaatatgtctttgttttacttctcgttagagctacttttatgtaacttgtagttgtattaacttcatgtaatattaatgaatattaaaacttttgattttagtcttgtctagcacttaaaaaatagacaaggctaatttatttggtttgaaaacacatgtcaatgagaacgtaattgaggattaatcagcatatgttggactgtcttggagtattacagaaactgggcttctgttatcagcatattaatatttgctgtagtttataaaggacgaaaagtatttgttgattagtagaatctgctttattagtcctaaaaatatcacaaagcacttaacactattgatttataatcaaacaaaatttagaaaccagatgtggattctcagtgtaatttgttgaaaagtgcttgttcttgatattcctgggaaactgtttaaaatgaatattgatcaattgtattaataggtagaattctctttttttaaatattatggcttggtagtgacagccttttggttca

SEQ ID NO: 336582 - DNA, 427 bp, Homo sapiens
caggcctacatcagttatttttatctgcatctaataatttgtgaccaaataatcatgaacacatttatcatatgattagaaaattcaagttcccaacctgtctttttaatatctctttcagcctgctcttgaggttcacagatgatacgtttgatccagaacttgcagcaacaatagtaagcctgtgtttaaaaattctatagaaatggccagtattttcttgcctttggcctttttaatctaaatccttctaccttcctctcaccaccccactgcctccatgtctgttgaaatcttatttgtccttcaagacttaattttggtatcattaaatctttgaagcctttctagatcttaccaagagaaaataacttccttatctgttgtctcatgatactttattaaaactgctaatgtgattatctgt

SEQ ID NO: 336583 - DNA, 1197 bp, Homo sapiens
ctcactaaaatgacagcatacaactggtttatgaaattattagatctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagctttt

SEQ ID NO: 336584 - DNA, 2840 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagtt

SEQ ID NO: 336585 - DNA, 3137 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagagattagtactcctattatgcccattttaaaggtgaggacaacacaatgtaggtatgttaggtaacccccaaagatcacatagctactcagtcactgagctggattccagtcatggcatttttacttctgagcccatactcttcaccatcgctcattttacaatgggtagttagttaccagctttttgtaacacaaccaagttaaggcagttccac

SEQ ID NO: 336586 - DNA, 2786 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaagttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagtt

SEQ ID NO: 336587 - DNA, 1191 bp, Homo sapiens
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagctttt

SEQ ID NO: 336588 - DNA, 2373 bp, Homo sapiens
ctcactaaaatgacagcatacaactggtttatgaaattattagatctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaatagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctaga

SEQ ID NO: 336589 - DNA, 217 bp, Homo sapiens
aaaatagataaacttctggcaagactgataaataggaagacagaaataaatgaagaacaaaaaagggaaataaccacagatttataatagaggtttttaaattataagaatgttacaaagagctacaaacagaaagatctgaaaactttcatagaaattttccagaaaatcctacccaaatttacttttaaaataattcaggctgggcgtggtggct

SEQ ID NO: 336590 - DNA, 205 bp, Homo sapiens
atgaggacttggagatgtggggatgggttaggaggctagaatcaagagatatttagtaactatatagctgactgaaaggtgagcctacattttgcctcagggacttcacagaaagtaatctgacaatttgctttgatgtttcacaaactcctcaagttcactcatccagtatcttccctgctaacctcctccctcatcagtggtc

SEQ ID NO: 336591 - DNA, 512 bp, Homo sapiens
gctcactcatcacagccaccctcccccttctgcttctcctgccttggagacaggatggatggactagaaacatgggccagcaaacagggatggacgacaggagcacagggaaggatgtggacagggacagacagcaacagagaacggccaggtgaactgtgtgcctatctacatccccgtgcttggtctggggccacagactgacaccaggaggccatgaaccccaccaaggtccacgctgtgaatgtcagcagctctcatgagtttaagagggttcctggcaaagtcaagaaccactgtggcgatgcttgaaggcagcatgctcattaagagtcatcaccactccctaatctcaagtacccagggacacaaacacgcagaaggccgcagggtcctctgcctaggaaaaccagagacctctgttcacttgtttatctgctgaccttccctccacatccgtcctgtgaccctgccaaatccccctctgcgagaaacacccaagaatgatcaat

SEQ ID NO: 336592 - DNA, 256 bp, Homo sapiens
ccaagtaactaaaaccagactggttaggttaagagctctttgaaaatggtggtgtatatattgtggccttcacagcacttgtcttattttctggaattgaaactcaagctacagcagttgtggaatgccatctagaaatgaaaacatgctcggacaatctatttagagaagttgttgagggctgttttcgatgtggatgataaccctgatagagcataaactttcagtgagaaatgaaaatggtcatacccggata

SEQ ID NO: 336593 - DNA, 280 bp, Homo sapiens
ataatgtttttataccagtgtgaataaacttagcatttttcaacaagtatgagtgttcatatgtctgaaaggggttagttgattatgtggatatgataaagttcttttaaagagactgagaactgtgttggatttcccaaaaaaaaaaggagtcctgtgttttatagggatggggtgctggggaagcaaggttttcatattgttttaaatgtagtttgatcattagtatctctagagctaacctacttaattattctattcctcagtatatcaatggaga

SEQ ID NO: 336594 - DNA, 228 bp, Homo sapiens
ctcttgttctgtacagcagtaacagtaagatgatgaaaagtagaaattaatgcagtaaggagataaagtcttgatgtctacctcatctttatgaccccagaacctagcaaggtgcctggcatgtagtaggcgcacagtaaatgctgaagaaatgaataaatgagaaaggaaaccatgctacttccatatggacattttcagttctcctggatggtggtgatggcggtg

SEQ ID NO: 336595 - DNA, 541 bp, Homo sapiens
gttgcagtgagccgagattgtacgcattccagcttgggcagcagaacgagactctgtctcaaaaaaaaaaaaaagccacgtaggaaattatccacagcatcaattggacttgatcttggctcagggaccaggcccggtgccttgatattggtagatttatttgccatcagactaatgagctggggacattgactgtttcctggcaactgagtcctctgattgtgtaaacaatttgcctgcaaacaaaacctgagtgcttgaaagggtaagtgatcctgatctgccatagaaaccttcatgcttagggagtttccctagctaattcctcagctaagattctccccaggagtttcactcacctgtttccagtgcctcctttgggctgtcagcatctgtgattccacattccccagagggagattcctccccaaagctggttgtatttactgccagtcctgggctgtagccagggcagtctttgaacacattatcaagaatactttttaaaataaaagtctgtttcgacttcaaaaaaatattt

SEQ ID NO: 336596 - DNA, 2473 bp, Homo sapiens
acactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgacctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgatttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccataattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaatt

SEQ ID NO: 336597 - DNA, 2006 bp, Homo sapiens
acactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgacctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgatttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggtgagtataccttgggagttaatcccgaagatagtcatgaaaggctaggctgcataggcttggagtggcaagttgatattgtaatatctttggtgaatgtgccccagtgatgcttcttgggggatgaggaggtgctggagatatgcacattctgtaatttttcaaatggtttttctgtggctggatatttccagttcttcagcattataaaccaatcaatctaggagctgaggttgcagcaccaagcatgtctggcctggatgctgtcctcatggagcttaccttccagtgtaagacagaaaatcaacatgtacac

SEQ ID NO: 336598 - DNA, 554 bp, Homo sapiens
taggcaaatgcaaaagtatgctgaaatgttggacagctcccacacacaaagattagggctcaagtcaaattctggggtattctggtagcattccttaatgtcagtcttctcaattagtctctgtctggggggagagcgccatctcctactcaaggaagcatggttctcaagacatccatcatgagttcttgctttcctgccaggcatgaacttttggacacaatcaatggtcatggccaagtagggcctacactagtaggataaagaaccagaactgtcctatttcctaaatccagcaaaaatcgagttggtaaggctgagaagggggcagatgactcctcagctggtcttcaacctggcaatctcatggggagggagtcacatccataccaagagtttagtcaccacctgaagtgttagggacatcaggcaggagctacacatcctcccgacctccccagaactttccctcaacaggaattttttctatccctggaacaacttctttctgtgacctggagaaggacttagctctaagtagagaaactggtgta

SEQ ID NO: 336599 - DNA, 147 bp, Homo sapiens
tctccccacacccgccggagatgccacccttcaactgcaacgatgttctcactcatctcttgatctttcgtgacaaagcacacactgcttttcttgcttccaaatttttcataaccaactggcacaccctcgctcatcagtcaagag

SEQ ID NO: 336600 - DNA, 530 bp, Homo sapiens
tcagctgggtgtgtttgtgcacacctatagtcccagctactctggagacgaaggtggatcacttgagtctggaaggcagaggttgcagagagccaagatctggccactgcactccaccctgggcaacagagtgagaccctgtctctttaaaaaataaagaaaaggaaaaagctgcctttgtggacacctaaataaaaaataaaatgaacctaaaacctactgggtgcagtggctcagaggccggggtgagaggatgtttgtgcccaggtgttgatgaccagcctagacaatggtgggagaccccaaccctacaaaaaaaaaaaaaaattagctaagcatggtcctgtatgcctgccatcccaactacacgggacgctggggtgagggaggttgaggctactgtgagtcacgatctcaccactgcactccagcctgggagacaagcccatctgggcaacacagtgagactcaatcactaattgaacaaaatccaaaaattttaaaaaatcaataatgcggtccaggaatgg

SEQ ID NO: 336601 - DNA, 202 bp, Homo sapiens
ccaagtttataataacactttaacgtctaatctgcggattcagaaaacccacatggacccaaacagggcttgtagtgggaaccatttctcttcactctaagtcactcccaccattaaatggagattgaccttagggaattgggaaggaaactttcactgtttttcactcttttccatttatctggtagatgtaaccagaaaa

SEQ ID NO: 336602 - DNA, 210 bp, Homo sapiens
cttcatcccagtgcccagttctagcacatgggcaagccagtatccatatgacccctagctgatatcaggggaaaaacctaaatcagtatgccaggttaactgtattatagtaagattaaattcacccattaatcaataagtagtcactgactacttgttatgtgaccagcattgtgccaagtactacgaggctaaaagagatcccccgtt

SEQ ID NO: 336603 - DNA, 831 bp, Homo sapiens
aggttatagaggtggcataaatctggaggttctgcaaagtcttcccagaggtgaagtattcaggctgatctggaactctggctggataatggagaagagcaatctgggcactgttaccactgggcagaatgacatggcggccatgccctcttcataatctcttgttgtgatctatcactgggacagaaggaaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtgatggtgcagcaagaggctttagaaattcctgttgcagagatttatataagactgccacatcttactggagaatgatgaaataatgaagcagaaataatctgaagataatacctgagaatcaaaagggataaagtaatcacagtgcattattccactagttctaaatgttttcaaataaaaaaagattaaagacaggcttgagaggcatacaaatgatttcgacaaagccataaatttgaaaatatgctgagtaaag

SEQ ID NO: 336604 - DNA, 765 bp, Homo sapiens
aggttatagaggtggcataaatctggaggttctgcaaagtcttcccagaggtgaagtattcaggctgatctggaactctggctggataatggagaagagcaatctgggcactgttaccactgggcagaatgacatggcggccatgccctcttcataatctcttgttgtgatctatcactgggacagaaggaagatgaaaacatttacttcagactgtttactactgttcgattctatttttcctttgattttctcttctcagtcataagtggaaatggaagggattcattcaaaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgcagataaaatttaaaataatatttatgagaatgtactagtttattgtaataaagaatgactcaatacatgc

SEQ ID NO: 336605 - DNA, 909 bp, Homo sapiens
aggttatagaggtggcataaatctggaggttctgcaaagtcttcccagaggtgaagtattcaggctgatctggaactctggctggataatggagaagagcaatctgggcactgttaccactgggcagaatgacatggcggccatgccctcttcataatctcttgttgtgatctatcactgggacagaaggaagccatcagaagtgcctggtttcatcaccaaattcagctttgggcatggctgtagatactgagattgcagtggtgaataagccaatcaaggcattgactctccccagtttccagcctggtagagggcaaaaatatcaagtaaatgaatgaaaacatttacttcagactgtttactactgttcgattctatttttcctttgattttctcttctcagtcataagtggaaatggaagggattcattcaaaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgcagataaaatttaaaataatatttatgagaatgtactagtttattgtaataaagaatgactcaatacatgc

SEQ ID NO: 336606 - DNA, 311 bp, Homo sapiens
gagaatcgcttgaacccgggaagcagaggttgcagtgagctgagatcactccattgcactctagcctaggcaacaagaacaaaactccgtctcaaaaaaaaaactcttgaacaacatgatttgatgagcctctgggctggtgaacacatccaggtgctgggagagtgatgccccctacgcttctcttccatctggttgtttctgagctgtatcctttataataaaccataaacacaagtgaaatgcttctctgagttctgtgagccattctagcaaatgaacctgagcagggggttgtggggaccctccag

SEQ ID NO: 336607 - DNA, 258 bp, Homo sapiens
cttcatctgtacctcttcctcccttgctctgtggtcatctgtgaacttatctgtcctggtcctaagtccttcagcaagcacagccgaggggtactcacaaaaatggcatgttcatcctcaggtccttctagagtcctctcactgctctcctgtgtctgctctgtaaactttttttttttgtttgagacagggtcttgctctgtcacccaggctggagtgcactggcatgatcatagctcactgcatctcaacctcctg

SEQ ID NO: 336608 - DNA, 968 bp, Homo sapiens
aggtctgatggagatgtacaagacgactaatgttggttccctgcctgctaacacaacatccgttctgcagcccatgggtcaaagagtaatttcaactttcaagtcttattatttaagaagtgcatttcataaggctatagctgtcactgacagtgattccactgatggatctgggcaaaatatattgaaaaccttccagaaaggattcaccattcaagatgctctaggctgctctggtctgtaactttccattccaacagtaaaaaatctgggatctcctacttttcacctcagaaagctacaaatgtaaaaggaaaattaaatttgttttgagaggaaatcacttattcaaatagccatgttattctgttttgttcataatatcaacggctctataaataaagaactttaaagaaatagcaaattcacccagagaaagctctgcctgcaatatttttcaggtcatgtcacacaaagaaaaataacaatgcttgcacagcccactgagataaaatggacaaggatgttcagtggtggaggtgatggctcaagggacttaggaatctgtctggaatgctgagagaccaacacgtccactaacctacagctattcacaccatcagggaagtgctggactaaagtaacaaggctctaacaactccagggatttctagaattgtgtatcatatactattcctaaaatataaaaagtaacattaaggtctgaggttaaaaaaaaaagagaatcacaatacatatcaattgctaagcagtgtaaagggttcacttttgcagtggtctagaactaaacccacaataccttttaggtagcctgtatactaaaaaccatcaaactgtcctctttaaacggatataaattataactcaataaagcacactgaaagcgcacccgtcaatatactgacacattaaatgaaataagagttgatagtattattactataagt

SEQ ID NO: 336609 - DNA, 946 bp, Homo sapiens
aggtctgatggagatgtacaagacgactaatgttggttccctgcctgctaacacaacatccgttctgcagcccatgggtcaaagagtaatttcaactttcaagtcttattatttaagaagtgcatttcataaggctatagctgtcactgacagtgattccactgatggatctgggcaaaatatattgaaaaccttccagaaaggattcaccattcaagatgctctaggctgctctggtctgtaactttccattccaacagtaaaaaatctgggatctcctacttttcacctcagaaagctacaaatgtaaaaggaaaattaaatttgttttgagaggaaatcacttattcaaatagccatgttattctgttttgttcataatatcaacggctctataaataaagaactttaaagaaatagcaaattcacccagagaaagctctgcctgcaatatttttcaggtcatgtcacacaaagaaaaataacaatgcttgcacagcccactgagataaaatggacaaggatgttcagtggtggaggtgatggctcaagggacttaggaatctgtctggaatgctgagagaccaacacgtccactaacctacagctattcacaccatcagggaagtgctggactaaagtaacaaggctctaacaactccagggatttctagaattgtgtatcatatactattcctaaaatataaaaagtaacattaaggtctgaggttaaaaaaaaaagagaatcacaatacatatcaattgctaagcagtgtaaagggttcacttttgcagtggtctagaactaaacccacaataccttttaggtagcctgtatactaaaaaccatcaaactgtcctctttaaacggatataaattataactcaataaagcaagatgcggccggaaaacacacacccccgcaaatgaatacaccacccaacg

SEQ ID NO: 336610 - DNA, 961 bp, Homo sapiens
  misc_feature (914)..(914): n is a, c, g, or t
  misc_feature (923)..(923): n is a, c, g, or t
  misc_feature (925)..(925): n is a, c, g, or t
  misc_feature (948)..(948): n is a, c, g, or t
aggtctgatggagatgtacaagacgactaatgttggttccctgcctgctaacacaacatccgttctgcagcccatgggtcaaagagtaatttcaactttcaagtcttattatttaagaagtgcatttcataaggctatagctgtcactgacagtgattccactgatggatctgggcaaaatatattgaaaaccttccagaaaggattcaccattcaagatgctctaggctgctctggtctgtaactttccattccaacagtaaaaaatctgggatctcctacttttcacctcagaaagctacaaatgtaaaaggaaaattaaatttgttttgagaggaaatcacttattcaaatagccatgttattctgttttgttcataatatcaacggctctataaataaagaactttaaagaaatagcaaattcacccagagaaagctctgcctgcaatatttttcaggtcatgtcacacaaagaaaaataacaatgcttgcacagcccactgagataaaatggacaaggatgttcagtggtggaggtgatggctcaagggacttaggaatctgtctggaatgctgagagaccaacacgtccactaacctacagctattcacaccatcagggaagtgctggactaaagtaacaaggctctaacaactccagggatttctagaattgtgtatcatatactattcctaaaatataaaaagtaacattaaggtctgaggttaaaaaaaaaagagaatcacaatacatatcaattgctaagcagtgtaaagggttcacttttgcagtggtctagaactaaacccacaataccttttaggtagcctgtatactaaaaaccatcaaactgtcctctttaaacggatataaattataactcaataaagccgatgcgtccgaatttttntttttttancnttttttttttttttttttttttnttttctttttttt

SEQ ID NO: 336611 - DNA, 308 bp, Homo sapiens
tctgcaagtttagcaattacaatttaatttattaaactgataagatttaggccacaatggttctataaacaaaaagatcatgaacagtaagttgttaatcctgaaacccccaagaaacaataaatgcttctacttgaattaaacttaaaatcattattgaatgtttcaaatcccatggtacacagagacagcaaattacacagatacagatctttccccttcttccgagtgggtgaaagataatttctgtgtgtttaaaatgtatggggaaaaaaggaaacatttagaaattaccttcttgtaataat

SEQ ID NO: 336612 - DNA, 587 bp, Homo sapiens
tctgatgtggtttgaatgtcttgtgtgtctcattacaggatttttttttctttaagggaagagatgaacttattatgacttagaatttatctgggatggggttttccaagtgtctgtcatttgtattttgcttttaggatttttatcacatctgtgtgcccacatcatcacataatattccagctcctcttttccatgttttttttgtgtgctctcagcatttggtgttactaagattttgtttgttaaatacactgagtgacaaagtatccaaagccagacacagtatttccaattcccattaactcaaaaaacagttattgaatgcttttgtcataggacacacagctgcccacatgttgattttaccacctgcccctcaattaatgcacaccatgcagtgtcgttgaaaaaataaggcatttggaatctcttctactactaattaccagataatcgtgtacattcatgtatacacaggcaagcctgactatgcaccagagccatgtacacctgatactaggtacctgataccatgtaccagacccagtacactcaacccttaaagcaagattctcttgcccaca

SEQ ID NO: 336613 - DNA, 381 bp, Homo sapiens
tctgatgtggtttgaatgtcttgtgtgtctcattacaggatttttttttctttaagggaagagatgaacttattatgacttagaatttatctgggatggggttttccaagtgtctgtcatttgtattttgcttttaggatttttatcacatctgtgtgcccacatcatcacataatattccagctcctcttttccatgttttttttgtgtgctctcagcatttggtgttactaagattttgtttgttaaatacactgagtgacaaagtatccaaagccacggtcaacccacaagccacggtcaacccacaagccacggtcaacccacaagccacggtcaacccacaagccacggtcaacccacaagccacggtcaacccac

SEQ ID NO: 336614 - DNA, 150 bp, Homo sapiens
cagatctctgttttgtttatactttattttgagtcagttgttggttgccagatactaactggtttctctctccccactgttctgctctcctctttcctttgttctgcggtggcaactctgttgttggtggggggcttggctcatgcgcgc

SEQ ID NO: 336615 - DNA, 404 bp, Homo sapiens
aataaaagttctatggacaaaaataatagaaaaagtgacaaagtgaaagggttgagattttaagtaggttggttaggaaagtcactgagtaggtaattgaatgtgaaagtgtacagacaattttgtaaaggcatacaaagaaaacggggcaggagttggagggagaagtagagccaaaatgtgtgtttgtttttagaaagggaaaataacaacatttgcagactaatgtgaatgattatctgtagaaaatataaaaccgatgatgcaggagaagggaggataattgttagagtaagatctttgagtaggtataaggaaatacactgtaaactggagcagagctggccttggataaaagatggacaatcaaggccaggtgcggtggctcatgcctgtaatcgcag

SEQ ID NO: 336616 - DNA, 3431 bp, Homo sapiens
  misc_feature (52)..(52): n is a, c, g, or t
gagcttgtctggccgcctcgcctcggagccactgcactgctggctgcagacncaggctgcaccatgaagccagccctcctgccctgggccctgctgctgctggcgacagccctcggcccgggccccggacccacagcagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctgtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaaggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcacggactacggctgtgacatggagcagggcagcgtgtgcacctaccaccccggggccgtgcactgtgtgcgttctgtgcaggccagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactggcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcaggaagggcaacacgcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttccaagaaaaaaaaaaaaaaaaaaaaaaaaaaaaaaaaaaaaaaaaaaaaaaaaaagaccacaaacaagaagacaacaacggcggcggccgccgcgccgtacagaaaagggctcaccccgcacggaggggggcgcacccaggatcttaaccgccgctgcaccacggtgatgctctgtgtgacgcaacagaagcgggcgcccaaacaataagaggcgagcgccagcaattac

SEQ ID NO: 336617 - DNA, 1929 bp, Homo sapiens
gctgttctagaggatcccatctcaggccaggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcaggaagggcaacacgcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttccaagaaaaaaaaaaaaaaaaaaaaaaaaaaaaaaaaaaaaaaaaaaaaaaaaaagaccacaaacaagaagacaacaacggcggcggccgccgcgccgtacagaaaagggctcaccccgcacggaggggggcgcacccaggatcttaaccgccgctgcaccacggtgatgctctgtgtgacgcaacagaagcgggcgcccaaacaataagaggcgagcgccagcaattac

SEQ ID NO: 336618 - DNA, 265 bp, Homo sapiens
cccttcccctgcaggtgccctcacccacagcccctgggtgccgaccaccctgtcctggggctgcgggaggggacaagatgctcacagcgggtgaccctaatgcatcccccttgagcccaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcct

SEQ ID NO: 336619 - DNA, 2937 bp, Homo sapiens
  misc_feature (52)..(52): n is a, c, g, or t
gagcttgtctggccgcctcgcctcggagccactgcactgctggctgcagacncaggctgcaccatgaagccagccctcctgccctgggccctgctgctgctggcgacagccctcggcccgggccccggacccacagcagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctgtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaaggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcacggactacggctgtgacatggagcagggcagcgtgtgcacctaccaccccggggccgtgcactgtgtgcgttctgtgcaggccagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactggcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcaggaagggcaacacgcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctaaccctccctgcctgtgcaaagagaaaacaagcgccttgtttccttccaagaaaaaaaaaaaaaaaaaaaaaaaaaaaaaaaaaaaaaaaaaaaaaaaaaagaccacaaacaagaagacaacaacggcggcggccgccgcgccgtacagaaaagggctcaccccgcacggaggggggcgcacccaggatcttaaccgccgctgcaccacggtgatgctctgtgtgacgcaacagaagcgggcgcccaaacaataagaggcgagcgccagcaattac

SEQ ID NO: 336620 - DNA, 2028 bp, Homo sapiens
  misc_feature (52)..(52): n is a, c, g, or t
gagcttgtctggccgcctcgcctcggagccactgcactgctggctgcagacncaggctgcaccatgaagccagccctcctgccctgggccctgctgctgctggcgacagccctcggcccgggccccggacccacagcagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctgtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaaggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcacggactacggctgtgacatggagcagggcagcgtgtgcacctaccaccccggggccgtgcactgtgtgcgttctgtgcaggccagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactggcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacatgcgtcctcctgctcacctacgattcctcgtcctgcctgagatgggatcctctagatcaccc

SEQ ID NO: 336621 - DNA, 92 bp, Homo sapiens
atgtgtgtatacaaatattggacaaaaagttgacatccgtcatacgcaaagttcccatcaatcaatattaaaaacaaacaagtcaatagaaa

SEQ ID NO: 336622 - DNA, 427 bp, Homo sapiens
gcattcaacattccatcctgtttcatcacgatcctacaacatattatctccccattttatagatgagaaaattgaagttcacagaggccaaccctcttaatacgtagaagagcagcgtacaagctccactctatgactccagagcctgataacctaactactatgcttcctggcttagcacttgctgggactttccacagaagactatcattccctgaactcagtgctggaaaatcaattgtgtgacccatttcaccaagccatggactcgcagagctttgtttctgtcccatttgactgagcaatgcttatgctggattgcaaaggtggaacacactccctggttcctcagaatagccactcctctttgctccaacaacattggctcttttgctgctggactagcccagcaaatgtgtcgatgaga

SEQ ID NO: 336623 - DNA, 1494 bp, Homo sapiens
ccttcccctgttctgtgctggaatcactgccaggtgctcctgggagggtccacgggatgatacccagcctgcctcttctactccacccaccctccaggcctagcatgtcttctcttgaggcctcggtttctacctctgtaaaataaagaaacctaaattcaactctatattctgactttcttaaatatttggcttgatttccccccaacaactgtgtacctcatcagctggggctgagaaactgcagcacaaggccaggatacagaaggagttcagcccaaactcatggcagtttgggcctcccttggctccttctttcttggaggacccagaacctagtgaaagggacccaagtcacccccaaggcctcggctaaaagtgccctcccctgccctcagccagtcctttattccatttcgtaaaggaaacctatcagctactccttttggctctgaacgtgacgccagggccaggccttcttttgctgttgtaattagcagagctaattgcatctgtcaggctgtgtgctgggcaagcccttggcaatttccaggatgtgggctgctgtgacactgcaggagccccaccctcctacccagaggacgcctggtttgggaagggatggttctcagacataagcgggcattagaatgacctagagggcttgttgagacacagatactgggcccagccctggcatttctgatcagcgggtttcaggttgcctgtgaaaatttgcatttgtaacaagttgccaggtggcactgttgctgctaagcacgttgagaaccactgtcccagagggaataccaggtggccaagaaatgggtcctgggcacccctgctgcttaaggctgtggtcagtcaaccctcagtgggagtagatgggcagtggggcaaaagcggtgtgatgaacaggttgtggggccggacacatgctcctactgttcctggttggttgtagtaattctgtctggaaggagaggaggaggtgaaggtggagccaaggagttgcacactgacatctccccaacaggtgagggcagggagagctccagacagggagaggccttcagagaacaggaaggaagctccctccctcctctgcattttgcagcctgtagctcacgtgccttttatgccccacatctcattctgtctggggactccatacgtagtggctgtctaccttcccgcgtggattgtaatgcttttgctaccaggggtcaggccatactcatcactgcaggccctgaagcatccatcatgttcctcgagctcagtatgtgctccgtacatgtagcacagtggaaaaacttgagctttgctggcaaagacagacagaatgagcttgaatctcagcccagctatggcttttctagtcctgtggctagaaaatgacttagcctcttggactttggttaacccatctgcaaaacagggatggcacccacctcttagaaagttacagtggtcaaaaaaaaaaaaaaaaaa

SEQ ID NO: 336624 - DNA, 548 bp, Homo sapiens
cgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaaaaacaaa

SEQ ID NO: 336625 - DNA, 243 bp, Homo sapiens
aaacatttttaaaatgttgctttcttaaaaatagtctttcgttaccatcagagtaacatgcacgttaataaaaagtttctttgtggttgtaggttcttcctaacctatacatatattcttctcccccatgtgataaatggggtatgctgatgactctgtagtctgtcagtttttttccccttgtgagctattgccacacagcattcacagactcaaaccagaattgcttatacgcttactgca

SEQ ID NO: 336626 - DNA, 775 bp, Homo sapiens
taacttgtggaatttcttggcacacactttcattgagtctgcggctgaacgggcttgctgggcgctcccaggagttcagcttcgagggcagccacatgtccgcatgttaggactcagagcacgcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccaggatgaaaaacccctgacctaacatctgttctggagatccggtggtccctaaaaccaacttacctgttaattaaggac

SEQ ID NO: 336627 - DNA, 4699 bp, Homo sapiens
ggcacgaggggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccagagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagaagcgtagcattgctctgtaatttggaaaccaagtcaaagatgtgtaagaggatgcagacagaagaaaaggcacgatctttgcataaaagcactggagtgatttagaggaaggcttgcaggctttagggacacgtatttttgctttcagatcctggattgctgcagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctg

SEQ ID NO: 336628 - DNA, 4666 bp, Homo sapiens
ggcacgaggggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccagagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggtctttggtggaggatcttgtaacacaatgaatgaatgcttatttttgcaaattctaatctaactcaagaggctgacacctgagagtgatttgagacttcttcaagttataaaggaagcacatctggccccaggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctg

SEQ ID NO: 336629 - DNA, 1090 bp, Homo sapiens
agaacctcgcctcagtaagttgcacaggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctg

SEQ ID NO: 336630 - DNA, 727 bp, Homo sapiens
acatgatgttaacagatactgagatctgagactcgatttggttctggttttactttttaggtgaaaatcctgtctctggacaccatgaggcacaccttgattcctcctgtgggtgctgcttagcaatgaggtttatttatgtctaacttcccctgaggtgctctgactccttttgacatcctgcttttcttctagaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgagtattcatctttccaaattgggcacctttctaattttgtgcttccatccttcattttgggagtacattaagaggaagccgtatcttcacatccctgctgttagaatttccttagcacactgagagatgtgtccatcaaccagctacaaacagtaatttaaaccattacttaattagttgcaattgcaatgaatagaggtgtgcactccttcataggtctcattgcaattgtagtgaaataaatcaccatgactcctctgctggaaagtaggtaccttgagaacaggaacaccggagacttattcatggcaggaactccagtgcccaccctgtgccctgtgcatagcaggttttccagaaatgttggtattatgaatga

SEQ ID NO: 336631 - DNA, 4273 bp, Homo sapiens
ggcacgaggggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccagagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctg

SEQ ID NO: 336632 - DNA, 4533 bp, Homo sapiens
ggcacgaggggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccagagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctg

SEQ ID NO: 336633 - DNA, 1652 bp, Homo sapiens
ctgatcctcacatggcaaggaacacctttgtgtacctggctccatgcctggcacttcattcacagtgggagctgttggcctggcgacgctcatcttgtcctccgcttctttccagggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctg

SEQ ID NO: 336634 - DNA, 214 bp, Homo sapiens
tgggccagacaaaggtgggtgaacccccgtgtgggttgtcacgagagcgcccgcccctccgcgtcactccatgcgcctctttccgagagcagggcttggctctcagcctgggcccgagtgcggccagccaggccagatctccggaccctgcccggacagagctggcacttccaagccctgctcactcatcctcgcctctgcctgcccagctcac

SEQ ID NO: 336635 - DNA, 907 bp, Homo sapiens
ttggagccgaggctttagagggtggcgttgggaagagggtctggcgccgccctatggactgttcgggctcacgaggctgaaggctccgaagaccgcgacctgcgaaccatgggaaggttccacgcggatgaaggctacagccccggccagagaccctacactaggcctggacttctccaccggcttatgacatgatagctcaataagctccttatttaacgcactgttgtatcaggtccctgtcgcagccactggccctatagcctaataaaggagcgggtgcatgcattggattggtgagctaccgccacagcaacgcgtcctaatcaaccatcccaaacggcagttggaagaaagttcttgcaggcctgtgcttgggcttgaacgctgggccggccgctgcgctctgtggctccctgcaggcctgcggatcggccagggggctccgatccttttggaccgaggctgaagcaacggctgcaccagagaaggccttctggctgaaggtggaagtgcacggggtccgcagaaccgcctaaggcgtcttcaggcgtgggttacgaactggcaggctctcctttgtgcttcattccatggccagagcaagacacgtgggcaagcccaaagccaggggctgggaaagtaacctccacccacaacgaaaccatggcaaggggtgggtgcatgtagggctgaggaattggggccaatagtctatctatcccgtgaggagacctgctgtgggggttgcacagcctgggtctgcaagcttcactgccctcggcctgggcgtcctgtgctcctttggcctctctgggttaggaaagtatcccttttatctctgcaaaggtcagagtcccagtgtctgctttcaaatataaaaccagctattgggggtatgaccctg

SEQ ID NO: 336636 - DNA, 444 bp, Homo sapiens
ggggccttcagggaagagctcgagtcatcatgaagacagagcctggatggtaaaattaatgcccctcatacagatgttgagtcacatgatgtattagatagtcaatgaaagatgaaattatgttggtataccatacaaggcagtaatgtacagtactccttaagaaacattttcaataggagttttatggttgcttgaattaagttgctttgagaggtaaaaagttgcagtaagtgctataatttagaaaaccagagacttacatggtaacatctctactggattaagtcttcatgagtataacagcataagtattataaaacttaactagaatcggaaaatagaagataaagaattagtgttttgtttggatcttacctttttctgtgcctgaaacccccacattttcaaaagtcctttcccaaggtctccaacgctggttgg

SEQ ID NO: 336637 - DNA, 489 bp, Homo sapiens
agaaggacatctgggaaatttacaaatatgtgaaaattaaacactacattcctaaataatcagtgagtcaaagaagaaatcacaagaaaaattagaaaatattttgagataaatgaaaacccaacaaaaattatgatatacagctaaagcagtgcttagaggaaaacttctagttgtaaatgacattagaaaatgagaggccgggtgcggcatgaggtcaggagatcaagaccatcctagctaacacagtgaaaccctgtctctactaaaaatacaaaaaaattagtagagacggggttttaccatgctggtcaggctggtcttgaactcccgacctcaggtgatccgcccgcctcggcctcccaaagtgctgggactaataggcgtgcaccaccacgcccagctaattttaatatttttaggtgagaggagcggggttttcaccataataggctcaggaaggtcttagatgtcttgagctcgtgatcc

SEQ ID NO: 336638 - DNA, 620 bp, Homo sapiens
cagtgcactccagcctgagcaacatattaagcatgcaaattaaaagaacaagaccttggccaggtgtggtggctcacgcctgtaatcccagcacttctggaggccgaggtgagcagatcacgaggtgaggagatcgagaccatcctggccaacatggtgaaaccctgtctctactgaaaattcaaaaattagctgggcatggtggtgcatgcttttaatcacagctacttgggaggctgaggcaggagaattgcttgaaccagggaggcagaggttgccgtgagcctagattgtgccactgccctctagcctggtgacagagcgagagtccatctcaaaaaaaagaacaagaccttgtctctaaaaaataaaaataaattataaatcaagaaagaaattaagacaaagaggagattaaagtttggcttataaaggaagggatgagctagagcaattccagaaagagagtcaagaggaaaaaggaacaattaactcttccccatccacatctcttctccctatccactaacagcagagtcaaactaaggaaggatttattgaataggtaggtggtggagaaaatacagaatgttgtggtgagagactgcactggcactgct

SEQ ID NO: 336639 - DNA, 249 bp, Homo sapiens
ggaaaacaggtgttaggagagcctgggcacatgggccagcagctacaactgctgagggagagagagacagaacagagctcaccagagctgagggtgaggacacagaagccttgagagagagcccagggcagcgtgcccagtgtggcagctggacatgctggtcattcagtcggtcaatgaacagccattgactcggtacctccatcatgtgccaaacaccaccaggcaccgagggcacaagacacagag

SEQ ID NO: 336640 - DNA, 559 bp, Homo sapiens
catgtgtggggaggtgataaaggccttagcccccaaacagcctttaaaagcttgtgggatgagagagctatttagaaagctgaccataacatgttccctttttcctgggcagtggctgagataatctagaataagggggctttgtgaaaataaatgaaacattgccggacagcctgcttgcttttccagcaggtaattatttgtggctcggagagggttcccaagcgacatggccgtcagggagagtcaggagagtaggttgcactggattcaccctcactgggcgtccattactttcttggaatttcctgtggcttgaactgtcctcattcctttgatccagagatataactttgctagtgttccctctcttgtgggtctcctcaacagggaaggagcctgcgcagagagatggaatgggaagggctaagagagcatacaccacagcgcttgtggggtgatgtagggaaaggaccgagggcacaagaaggacagagattgagataaacttgaaactgcttagagcagtttatctatttcagacacgatacagcacact

SEQ ID NO: 336641 - DNA, 418 bp, Homo sapiens
gtggcaggggagatggggccaatgtggaggatcatagggcttgctgaaacagtcccaaatgaatcttcttcaaattaacctctgcaaatattgcctctgcctccattaatttagagaagctttgcattcttttctcttaagtttattttgcagctcatgtcttaatgagctaaaaaaaaaactatagaggttttgatccaatttcagactaccctgtaagatatcagcatctgacagttctgctgtactctttcaggcattttacttgaaatgatagtaatgtgatatttgcatccagtgcaaattatgaattttcactaattcttagattagatggggcttaactgctaggatgcagcttgcacatttaatctacttcagagcagcttcacttactagatggtcctcatgggtctgg

SEQ ID NO: 336642 - DNA, 259 bp, Homo sapiens
ggctccatcatttctcaacctttttgtgctatactacagttgcctcacatccacattcaaggttatcgatccactcttaatagctgtgtctcatctattgttgcccatcaaatgagtttacagtcaatgatcacattatcttcattctttctcaaaacgcttctaattcatgctcttatgacatttttttcattaccctcagtcacttgcaacatactttcacagtctatcttggatagctccctaattcctagatctt

SEQ ID NO: 336643 - DNA, 275 bp, Homo sapiens
tttgcccccttcttgtcccctttgaggggcacttaagatgcagcaatcagctgtggtttcagtgaatcatggtcacctgtatttattgctagcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 336644 - DNA, 249 bp, Homo sapiens
tcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggtggggagctgtagttgccccctacctctcccacctcttgctcttcaataaaatgatcttaaactgc

SEQ ID NO: 336645 - DNA, 1385 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgcaaaaaaaaaaaaaagggaggacgctccaacgaaccc

SEQ ID NO: 336646 - DNA, 1105 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 336647 - DNA, 1371 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacaggcaggcggcgggggcccccacctgcaccatccaggcagccgggagtgggagtaggcccgggcccccagaccctcaaatgcgcactaacaattccctttccttcccaccccttctcactctggacttctccctggaggggatgggacggagctgtctttcctcccccacaggcaggactcagtgtccctgcccctgcccgctaaataccctagacagagccagaaagcacattccagaaccaggcaacctgccttcaaaccctctacactcaccatgtgacccaactgctgtgtgacctcaagcaaatcacttcacctctctgggcctcaccttccttgtcttgcaaatggagatcatgagagtgccccatgggttattattattattattcgagacggagtctcgctctgtcacccaggctggagtgcagtggtgcgatcttggctcattgcaacctccacctcgtggttcaagaccagcctggccaaaatggtgaaaccccaccagtactaaaaatacaaaaattagccgggcatggtggtgcgcgcctgtaatcccagctactcaagaggctgaggcaggagaatcgcttgaacccaggaggcggcggttgcagtgagccaaaatcacgccattgtactccagcctgggcaacagagtgagactccatttcaaaaaa

SEQ ID NO: 336648 - DNA, 560 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagcaggtaaggaggctgcggcggggtcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgcaaaaaaaaaaaaaagggaggacgctccaacgaaccc

SEQ ID NO: 336649 - DNA, 696 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgaccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 336650 - DNA, 554 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagttttaaaaggggcccaagagacgcccaacatcatcgagcagcgcagcctgaagtggatcttcgtcgggggcaagggtggtgtgggcaagaccacctgcaggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 336651 - DNA, 1349 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 336652 - DNA, 956 bp, Homo sapiens
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 336653 - DNA, 764 bp, Homo sapiens
  misc_feature (608)..(609): n is a, c, g, or t
  misc_feature (611)..(612): n is a, c, g, or t
  misc_feature (614)..(614): n is a, c, g, or t
  misc_feature (620)..(620): n is a, c, g, or t
  misc_feature (633)..(633): n is a, c, g, or t
  misc_feature (637)..(637): n is a, c, g, or t
  misc_feature (650)..(650): n is a, c, g, or t
  misc_feature (653)..(653): n is a, c, g, or t
  misc_feature (656)..(656): n is a, c, g, or t
  misc_feature (659)..(660): n is a, c, g, or t
  misc_feature (666)..(666): n is a, c, g, or t
  misc_feature (670)..(671): n is a, c, g, or t
  misc_feature (675)..(675): n is a, c, g, or t
  misc_feature (677)..(677): n is a, c, g, or t
  misc_feature (689)..(689): n is a, c, g, or t
  misc_feature (745)..(745): n is a, c, g, or t
aaagggcatggactgggtgtttggctggttgctaaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttgctgcggtgtggtgtatttgacagctgtgcacgcgcacgtgtgccnncnncncttgantgcttgctgcaancttncccccacccatgngtnggntgnngtgtgncctnntgcngngcttcattgcangatccaaagaaacccagcatccatgcccttttccattctccaccagcattgttgcncacattgcctgtgtgccct

SEQ ID NO: 336654 - DNA, 219 bp, Homo sapiens
agagaggctgatccaggagctggccaagtgcaagattgacacacacaatataattgtcaaccagctcgtcttccccgaccccgagaagccctgcaagatgtgtgaggcccgtcacaagatccaggccaagtatctggaccaggtgtgcccacccacccagcactggctcagcagaggcacctctgcccctttattctctgatcttttgctccaccatct

SEQ ID NO: 336655 - DNA, 219 bp, Homo sapiens
ttatacctgagtgagactatcacaagtttttaacttttttattgtaaaacatggcaaacatacagaaaagtgcataaaacttaaatgcacagcttaaggaatcataacaggcatgtaacccctgtccaggtcaagaaacgaaaacattaccaacctccagaagactttgtcccttcccaaccataaccctttcaaaaccattcacaacttgctccccac

SEQ ID NO: 336656 - DNA, 161 bp, Homo sapiens
agcattggtgttcctctcaagccctgggtccagctatctgccacacccctctgcaagaaaaaaaaaaagaagtcagagactcagccctgctggaactcttgcttccaaaaaatatgcaatcggccaggcacggtggctcacgcctgtaatcccagcacttt

SEQ ID NO: 336657 - DNA, 341 bp, Homo sapiens
gaacaatctgattcacacttggaggaggacacaggagctgaatcagatggggctgtggtgcctggggaggaaattttttattttgggatcctagaacgaagagacaatgaagatgacatggaattcatcaacatgctttccttgatctacacaaccgcctgccccatgctgctggcagagcagtctgttctcttggcctatgcagatgccatagtatacaagtgttaaaattgtggtggatcccagaagcgtgcagacatgttcagatgtgtccagagttcctttcttctggtgggttcgtggtctccctgacttcaggagtgaagctgcagatcttcatg

SEQ ID NO: 336658 - DNA, 141 bp, Homo sapiens
attcagaaaaataagacactttacatgtagggttaccatgataaggatgatggctgtcttttcctctgcaataatgaatgccagaagataatggaaaaacatcttttaagtgctgaacgaaaaattacttaccgttaacca

SEQ ID NO: 336659 - DNA, 418 bp, Homo sapiens
gctggagtgcagtggcacgatgtcggcttactgcaaactcggcctccaaggttcaagtgattctcccgccccagcctcctgagtagctgggattacaggtgcatgccaccacaccctgctagttttgtgtgatttttagatatctgcacgaaaatactacagagctgtcaccttactttcagggagcagccaacttctatataattcaatgtttcaacaaagatcattgagtagttaatacatgcagagaactatggctggttataaaaggtgtgggtgcaggtctctgtttatgaatggattaagtttcaagaatccctttgtgaaagtcaattatgtagaaacttcaaatgcattttcctacagaaatcatggttataaatggtgatttgatttccccatatttaactcataagtt

SEQ ID NO: 336660 - DNA, 379 bp, Homo sapiens
atggcttcagcctgacaaagtcgatgataaagaaaagagtttcccagggcccctgagaaccacaagcgtttcaccaacaccttccctcaccccctccagggaggaccgcagccagctgcccacatttcccagcttagaagaggctccttaacgtcagcgatagcttcagtgtactgggaaaccagtgtggtgtctgtgggctcctcccggaggaggaccgggaacgagtgggcgcctcctgcagagcactgtcaccagcccaggtcagggtgcagctgcagtactgacggacccagggtcatttcagataacaaacttggaagagaacttaatttcacctcagcagactgatgggctaaaactaagaaacccgtttgag

SEQ ID NO: 336661 - DNA, 232 bp, Homo sapiens
ggaaggtccctgccctcatgcagggaaaggtggggcagtgatggcatgaaacctatcattaccccattaataatctaatcaacatcgtggtaaatgccccaaaggaagctccagggagctccaaggtgtctgacacaggagcctgacctggggagctgctgctggggctgagcgctcaaaggtggaggaagaaaccaagggaaggagccgggaactgcaagcacaaaggccg

SEQ ID NO: 336662 - DNA, 340 bp, Homo sapiens
cactgactgatgatagttaatgttagagattttaggagagaagctgggaagacaaacctcaaacctctttagccagttaacgaaaaattctctattttattctttctttttcttaattatcctaatgtcattcatttaagaccttaatttttaacgagtctccttttgggtctctatttcagtcaaagctcgttgaagaccatcccttttcatttttaatgtgtaatttccatttaccaagagtagcttttggtacttttaccatttaccaagatcaaaccatttacctctacacatagcacctctctcctccatcccattatgcctctcactaaagcag

SEQ ID NO: 336663 - DNA, 376 bp, Homo sapiens
tgagaaaaagggaaaaatattaaaatcaactacataacagctgttatgaaccaattattatgttaagacatagttcttgttttcaaacagctctgagtctaggagctatttctgtacactatgtacacaaatagctattacaatggagaaaaatgataatgccattaaggaggcataaataaaattctgtgagttcagagtttaccttactaaaaaaaatagtatcattggaccaatattttaaagtagaatagaatagatcaaattaagacctgaagatatggcaaagaaaggctttctatacagaggggcagcttgagccaatagcatgggagtgctcaagagcagaatgtgttcaggaaacagttcatatttg

SEQ ID NO: 336664 - DNA, 331 bp, Homo sapiens
ttatataatggggaaataacacacagtatactgcctcaatacaatctcctttaaaaattactttcatattttactatacctacttattgtaataagtataatatgattagtttaacaatgttttaaaatttcatcttatcattattcttctattttgggatccatattttgaaggaaatcaaagttcatgctcttaaactatgcttgagttccagcacccagaccccctgcaaattaaggcagaactctcctgcctctcccagttcttctcagaccatggccagccccactccattcccagactaaacacctcccccactcccagactaaa

SEQ ID NO: 336665 - DNA, 468 bp, Homo sapiens
atcaggtacaggccgactcacagaaacaggaagttggatggtggttgccaggtactggggggagaaataaggggagctaccgtgtaatggtcatagagtttcaggtttgcaagatgaaaaagttctggggacaggttgcacaaaaatgtgcgtatacttaacactacagactgtacacttagaattggttaaaatggtaaattttatgtcatatgcattttatcacaattttaaaaagtcacttatgatccacatgatctcaacatcagaactgaccaatgttaacattttggtatataactctgtctagtttgtagatttttctttcctaggtgtatgtgtttgcaaatgtgtgtgtgcatacacacataccaacacaaaatttgctctgttcgtctgacagttctgtaggcatgtagagaactacaaattagacaagatagttcctgctcacatgagcagagagat

SEQ ID NO: 336666 - DNA, 328 bp, Homo sapiens
ctattttttatcaaatcatcttaaagcaaaacaatccgtctctgcaacacaaaagcaaataagtattgaaaacttatttaagtaagatcgattttgctaatgtcaagcttaaggcaactcagcaagaaatgacaacaactgtactaaattatctacattcgtgacatcttagctgtgtctacaaggcaccaaaacactgtgatgaaaagtaaaagtcagtaattgcccagatgttatgtctagtcaccaacagctggaacttcctcagtatttgctctctctccctttctctctaagcatctttgggagtttgctaacagaccttttc

SEQ ID NO: 336667 - DNA, 326 bp, Homo sapiens
gagaacacaaggatttgtgagaaagatgagaagttgaaatcaggtttatgatgaatttgaaatgcctataaaacaaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacaggtatgttttgggcacagacacttttagga

SEQ ID NO: 336668 - DNA, 2762 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaagtgagtttgcagcagctgcaagacgcaggcaagatcctgcctacactgctgcctctccctcgcctcagctgtctttctaataacttgaagtttttctgttcatagatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttaaa

SEQ ID NO: 336669 - DNA, 2880 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaagtgagtttgcagcagctgcaagacgcaggcaagatcctgcctacactgctgcctctccctcgcctcagctgtctttctaataacttgaagtttttctgttcatagatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggctcccttctgttgccacatttgggccaaggaatggagagatttcttcgtttggaaacattttgccaaactcttcagatactctttcctctctgggaatcaaaggaaaatctctactagatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttaaa

SEQ ID NO: 336670 - DNA, 2657 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttaaa

SEQ ID NO: 336671 - DNA, 2745 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggtaggttgaaaccctaattctggttttactgttcaaagcctcccattttgtgttcatttctgacacagttttttggtttgtttcttaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttaaa

SEQ ID NO: 336672 - DNA, 609 bp, Homo sapiens
gaacccagtcatatacttcttagcaccatagctaaatcgatatactctactcacacatcctctccattctctgaattcccacaaagactgttattgctggggctcataaaattatactccaaagtatgacgctttggcatccagagtgctttgaactaaaggagactgaaggccccagaagccaagtttccctctgaccttctcctgccttcctgtcttccaccccctacttttcccctgaagtgagtcctggaaaccagaattcttcttgcccaaagcaagccgtgacaccctggaaatatcactctaaccttccttgcctttccgtgtggcagctggccatgaagaaattctctgacctaccttgtttgatagcagatcacaagaccctggttccagagcggtcctgctttacaccgagggaaaggaatgtcatacagaaaggccaagaagaatctgaagagatgtccaatcacctttgcacgtggctgcccattcttcattgaacctaagcattaaaatagacagtttcccctgggtctttgggtcttcatttctgaagactccatgtcatgtaaaactttgattaaataaatgtatcatgcatta

SEQ ID NO: 336673 - DNA, 791 bp, Homo sapiens
gaaaaatcaagtctttactagaggattacttggatcagaaaccggagcctgatggcaacctcccagggcatgcgtgcggagtgctggacagttcacgattcgtcaactgctggactcgttttgctgagtggggtgtccaggctgaggacaaatctgagctacattcctcaagacaaaggagggcactcattgagaaaaaggcaaagaaaagaaggagatacaaagagagggtcatgctaagtaaggaatttgggaaagaaatggacatgtgtacagggatgatcatggataagcctgggcatgtgggttgaaatcattctatccagctctcacaggatcctcagtaaaacaagctcttgcagcgatgggatttgttcactttggacatgagacagcctggagagtctattttcttctattccccctcactttcttaaagtcttacttaaatgtttataatgtttacttttgttttagctaaaaaactaaacttttctcagtttaaaactactaattctgttatttcaaatatcccaatccttatttgaataactgtgatgtgtttgttatcctccttacagtagcccggtctgattctggtgaggaattgggtcatgttttctgtccccttagaccagtatggaaggaggctgtggtgtgtgacacccaaactcctgagacgggatagagaagataccttattttcacggacacagtctgattaccgcactccgattacgatctgatctgtgtgaaaacccttcctgtccatgctgatcctcgacagcttg

SEQ ID NO: 336674 - DNA, 189 bp, Homo sapiens
tgtgtgcatgtgtttgtgtgtgtgtgtgtgtgtgtgtgtgtgtgtgttggtcaggactcttaagctgtaattgccaataagccagcaagaccagaatggttcatgaactgaaaactccagacacccctgtatcttggaactacatcaatatgcattctctctgtattgggctattctgctttcctctgt

SEQ ID NO: 336675 - DNA, 109 bp, Homo sapiens
tgtttaccaactgtgtgttaagaacatactgccttggctggagggatgtccccccaggtttcctccctaagtggattcaatgttgagaataatggagaaaactaccccc

SEQ ID NO: 336676 - DNA, 504 bp, Homo sapiens
gtgtcaattttttctttgatgtatagtgtttctgaggttttaagaaatttaagaaatctttgtctaccctgatggccttgcattctgaaaggaaagaggctaattcagggcagcctcattcattaaagtttcaacaaacatcagagcatgagtgccttttccagcctttgacattaagcccctgggctttattttcctataatggtatgagcaaccctcaaatgcaatgtggcagagattgtctggcttgttcagaaggcagagtttcatttaatctggtctctatagaagtaggattggcccaggccccaaaaaacagacagttaactgagaggtccccaaacccagagagaacctaagagcaatttcccgatagtaggaacttgctctcattgcccattttcagatgtgtcatttacacaagtgaaagcaccgtcttataagataagtctttatagggattctcggcttgccccagttttattattgagtggggaaaaaacc

SEQ ID NO: 336677 - DNA, 292 bp, Homo sapiens
gcctctgtgacttttccacgccgtgcaccccctcctccctgtgtctcattccccgattctgaaggaagacccccagggtagtaatttaaggcttaggatcccaggtacgcggacctgcgcaaggagcaaattttcggacttattctgacgcctgcgtgttatttgtccgtggcgttctctgtaaattcctgtaaggaattactttttttttctcatccctggacttgtctttgggggagagagggaaaaagtgtagcgctgcttttctttttatccttaataatcctatttt

SEQ ID NO: 336678 - DNA, 1151 bp, Homo sapiens
ctgccgtgggacatggtttctaaagaacaaatgccagctgtggcgctgaaagggcctcctcatgtcagggtgcccctggctgcaggacacaggccacttctggtcccagattgacgggcctccagcccaagtggcacctgggtccctctgacctgggctggcatcccccaggccatggggtcacaggggaggtcactgccactcttgctggctgggagaggcgtgtccccacgtgcgtctggccgcagtcagtggccaggacctgcctgcgtgtggacagttaggcctcctgcctaggaagcagtgatgcttgccggctgctggtgggggcaggggaggggctggctgccggatcccacgcagcctggacgtggctgataagctgtgaactcattatcggagggggcagctggtgcccctctccctgcagccggcaccccagccttgccctggggccagacccctgcactgtgcccagccttgcgggtgagactgggggagcgagcaggcctctgttgggacttgggagtctccagggtcccccagagcccagagatcctccctccaggactctggagacagccgccgttctgccctccctgctgacccctctgccctccctcaggtctgcctggccgcctttctgagaacaaggagccgattgttgtcaccactgctgtctgcctcctgctgtggatgccttgcttggcgctggcagtgcccacaccggcagggacctggggacttggagccggacctaggtcgccggccgtgtgcctggtgtcggggcagggctggtggtcaccccccctggggttggccccgtgggctcagggccctgcctccctgtgccctgtccgtagggaccctctcatgccctctggccagcctggagagctcttggcagaaaggccaggactgaggtggctggcatggcgcctcccgcgctgttcctccctccctgcctggccttcaggggcgcgtcgtcctccccagaccctcctctgtctgcgtgtgagcccgtgagcctgtgtgggcttatgtgtgtggctgggattccagccagggtttgtgcgcgtgagcctctgtctgcgtgtgagcccgtgagcctgtgtgtgagagtgtgtgggtgccatgcctgtgtgagtgtg

SEQ ID NO: 336679 - DNA, 278 bp, Homo sapiens
agcacttggcctgaggctatgttaataaagatactgccttcaaaatagggaggtgctctacagtgatcattcattcaactgacctttgtcattggccagacataggacagaatggttctgcatctggggaacaccactgaagtaaaagaaaaatctctggccttttgtagcatatgttccagtgggaagaggcagacgatagatacactataaccagagtaaggaaggaaagtgctagaaggtggtaagtgctgtgaggcaggtgatccaggatgtgg

SEQ ID NO: 336680 - DNA, 286 bp, Homo sapiens
ggcacagaaattaaaatgacactgtaaggctgcaaatatcagataaactcacaactttagagccagaaaggatcacaggaaacatcaacatccagttctccctcttttgcttcattgctgagaagaggaaagccctgaggaacaaaggcacttgtccagggtctcccagccagtggggacagagacagggccagaatctggtcttcctgatgtcccagtacaatgtccttccttcttgactgcacaacccttgcattgtcgaatttaatttctgtgcccatttcaa

SEQ ID NO: 336681 - DNA, 103 bp, Homo sapiens
tctgtaccaatctcctggacaggtggagggaaggccccttccccgacagatcttgcaatattgacaaggcatcccaaactaatgctatgaaagaaaacattcg

SEQ ID NO: 336682 - DNA, 338 bp, Homo sapiens
tgaacaactcaaatgcacctcaaactcaacatgtataaaagtgaaccaattatcttctcccaaaactttatcttcttccaatattatctatcccagtatatagtggcccattcctcaaatccaatcaatcatcaagtatgcaattttacttactaagtatctctcaaatctattgcagctaccatcacccaggtccaaactaaaataatttctcttaggctactgcaatagcttcctatctgatctacccaaatccaactattctctagatggttgccagaacaatcttcctgaagcttaaattaaaccacctcttgcttctctctggataaaatgtt

SEQ ID NO: 336683 - DNA, 1625 bp, Homo sapiens
ctggaagggagggggcggggttgtgagcaaatcttggtggtggtggtggtggggcggcctgagaagatattatggctgctgccacggagcataatcgcccgagcagcggtgacaggaacctggagcgaagatgcagccccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcgtccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagcttta

SEQ ID NO: 336684 - DNA, 1985 bp, Homo sapiens
ctggaagggagggggcggggttgtgagcaaatcttggtggtggtggtggtggggcggcctgagaagatattatggctgctgccacggagcataatcgcccgagcagcggtgacaggaacctggagcgaagatgcagccccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtagcctgtgaacatacatgacacaagccctatgggaaagaagatttcatactcatcacccttctataataggatgaatgagccatctttaggaacctcacttggaatacagtcagctctaagagtgtccttgcaaacaggagaagttgagcacataccttacagaggacatagtacattattcatcaccctcaccatcatgctgggagtacatgcatgagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcgtccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttaaaacaacaaaacaaaaatgtcctcgctggcctcagcagtggactctgcagccgcttcccttcatgagggtaagcaatgagctcgccactgactcctgccatcgatctcatgcatgccccacccgctcactcccaaaagccgact

SEQ ID NO: 336685 - DNA, 582 bp, Homo sapiens
gagagagcaagcacatgtgtcactaatgttattcctctgttctccctgctaactctattattataaaccaccaggggatagaaattgacgagaattgaaatgctcagcaggattccttggcccattcaattctttgctggctcaaaacagtgctagcaagaattgctgtggagagtgactagcagtcatacactcacaccatgctgaatttctcactgatggtcagttaatctatatgtttggaatatagttctggaatggatgatagcttctttttttaacccttagccccatgaaatggtaggaagagaatggagaaaggatggccctttaagcatattttgaggtgcctccaaaaaaaaaaaaaaggaggaaagatgtctatttagtctctagatataaaagctaagtggatttggaattttatgcatactatttgatttatcaacagaactactaaggaaagttcaactgaaaaaaatacaaatgtattttaatatgttagtgtgttccttttaatacctacaaatttaacctaactataagcagtggaatttttaaaaatcaaatttcatagggggg

SEQ ID NO: 336686 - DNA, 1855 bp, Homo sapiens
atttaactattaactagtttaactggctgataaatcgcttttgcagaaatgtcatagtaaaattggttttaaattgaaatgggcttcttcgatcaagtcactgtttcgtttcatggtgtaaaattcaagttttaaatgagaaacaatttaaaagtatgcttgtttacctgccttttaaaaggaaatattttctatcttacatagaccattttctagccgtaaaagtttgttttggggctggtactagcgcaagtggacaaagcaggcatttgtgtcaaagataatgcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcgtccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttaaaacaacaaaacaaaaatgtcctcgctggcctcagcagtggactctgcagccgcttcccttcatgagggtaagcaatgagctcgccactgactcctgccatcgatctcatgcatgccccacccgctcactcccaaaagccgact

SEQ ID NO: 336687 - DNA, 1250 bp, Homo sapiens
gagagagcaagcacatgtgtcactaatgttattcctctgttctccctgctaactctattattataaaccaccaggggatagaaattgacgagaattgaaatgctcagcaggattccttggcccattcaattctttgctggctcaaaacagtgctagcaagaattgctgtggagagtgactagcagtcatacactcacaccatgctgaatttctcactgatgaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacagagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcgtccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttaaaacaacaaaacaaaaatgtcctcgctggcctcagcagtggactctgcagccgcttcccttcatgagggtaagcaatgagctcgccactgactcctgccatcgatctcatgcatgccccacccgctcactcccaaaagccgact

SEQ ID NO: 336688 - DNA, 1008 bp, Homo sapiens
ttaacgtcatcctctttagagggtaacttgcagaatataaggtagatgttggttacagacagtaattggtattggtaaattggttggttttttttctgtcagggttcccaaggctgtacataatttgtacagtattttataaagaaaaaaaaatgatgcttagatttttctaaacattacctttttttttttaatctaagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcgtccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttaaaacaacaaaacaaaaatgtcctcgctggcctcagcagtggactctgcagccgcttcccttcatgagggtaagcaatgagctcgccactgactcctgccatcgatctcatgcatgccccacccgctcactcccaaaagccgact

SEQ ID NO: 336689 - DNA, 301 bp, Homo sapiens
aatattgaggcccacttgcggttacagacaggtaagcaaagtgctaagtggcacctcataatgaacctttgcaaatggttaaaaaattgcagttcatttagtcaccaaattttcatttagctcctaacatttcttgaacagtaagtgccagtcactcaggaagtgttatgtgtatgtcaattcacttaaaaggtcatagtacccttttgagatggtggtggtgttatcactgtacagataaataaattgaagtttaaagagcccaagcaaacatgcctaagatactaagtgacaactctaa

SEQ ID NO: 336690 - DNA, 1790 bp, Homo sapiens
ctggaagggagggggcggggttgtgagcaaatcttggtggtggtggtggtggggcggcctgagaagatattatggctgctgccacggagcataatcgcccgagcagcggtgacaggaacctggagcgaagatgcagccccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagatggaattgtgttgttctcagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggatttaaaagtcacgtaaaagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtggtccagtgccaagagacatttatcagagaattaaaaaacttgaggataaaatccttgaattggaaggcatctctcctgaatattttcagtctgtaagcttttctggaaaaagaagaaaagttcaaccacctcaacagaactattcactggctgaacttgatgagaaaattagtgccctcaaacaagccctcctcagaaaatcaagagaagcagaatccatggcaacccaccaccttccatgaaaaactcctctcgtccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttaaaacaacaaaacaaaaatgtcctcgctggcctcagcagtggactctgcagccgcttcccttcatgagggtaagcaatgagctcgccactgactcctgccatcgatctcatgcatgccccacccgctcactcccaaaagccgact

SEQ ID NO: 336691 - DNA, 311 bp, Homo sapiens
tctgctgtctctgaaactcaataacatcatcataattttttataccatttgacagatgaggtgaccgaggtgggaccagagcctggttctgggatctttccccaataccacgttgttccctgacatatgctggaagggaaagagacatatgggaggatgtggagggtataaggcttattgctagaggtggtgaaactgaggcagcagctgatttgtgctttagcgagggcttcttgctttgacttccctcagggaaatgaaagcataaggcttccactcttagtagaagaagaaagtcctcagccagccag

SEQ ID NO: 336692 - DNA, 130 bp, Homo sapiens
gttaaaaaaatgcaattaagatgattttatgtgagagctgtggaacgaacataatatttggggaagagttggtttgacttaattctcaaaccaagagctttcatggaacttcatttttcactccaacctc

SEQ ID NO: 336693 - DNA, 210 bp, Homo sapiens
ttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacag

SEQ ID NO: 336694 - DNA, 317 bp, Homo sapiens
cgaaataaggactgaggaaagaagaggtaattaagatactttctcgttggctaaagaaagggatgcatagcaagtttaaatatcttgcagaaggacacacagtttgcaagtgaaggagctctaattcgaagactggtggtctgcatccagagttgatcatcctaaataccatgctgaactggttgctcccaaagactgaacagtattttttacaataagatattcatttgtacgtcaacaaatagttgccaattctttgtaaaataaaatacaatgaactgaataaaatttaatacatcagagtaaattttacatag

SEQ ID NO: 336695 - DNA, 100 bp, Homo sapiens
aaagaataataaactgtgaaaatgtgactaaattatgtgggaggcttaaaagataagtcattttaataaggtttgcaaagtattctctggtctcaacttc

SEQ ID NO: 336696 - DNA, 241 bp, Homo sapiens
aaattgcagctgatctatgggaattattccgctttagcccaatagttattttagatagtaaaattattttaaatagttattttaaataactatttaaattaaatattttaaatagttaaatagtaaatttacttggcttcaaccctctcctaccccatctctcaaaccttgtgaactccaaatttgagaattgctttatggcattaaaaaaattgtgaaaatttctgtgtctcagcttata

SEQ ID NO: 336697 - DNA, 1604 bp, Homo sapiens
  misc_feature (1565)..(1565): n is a, c, g, or t
  misc_feature (1570)..(1570): n is a, c, g, or t
aacctacgccgacttgaagccctggggttggtcagcgccagaaatggctaccaggggctagtggacgagctggccaaggacatccgcaaccagcacagacacaggcacaggcggaaggcagagctggtgaagctgcaggccacattacagggcctgagcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacccagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggtaggacatggaccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgtttaagatcttgttatttcagcttcataagatcaaagaggagtctttcccttttctcttttaccctcaggattctcatcccttacagctgacttctttcacgaaggggggggcccaaaaaaattttttttnttttnccccccccaaaattttgaaaaggaggaaaaattt

SEQ ID NO: 336698 - DNA, 1661 bp, Homo sapiens
aacctacgccgacttgaagccctggggttggtcagcgccagaaatggctaccaggggctagtggacgagctggccaaggacatccgcaaccagcacagacacaggcacaggcggaaggcagagctggtgaagctgcaggccacattacagggcctgagcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacccagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggtaggacatggaccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgtttaagatcttgttatttcagcttcataagatcaaagaggagtctttcccttttctcttttaccctcaggattctcatcccttacagctgactcttccaggcaatttccatagatctgcagtcctgcctctgccacagtctctctgttgtccccacatctacccaacttcctgtactgttgcccttctgtcgtcttctaaaagcagctgttactcccacatctgttg

SEQ ID NO: 336699 - DNA, 991 bp, Homo sapiens
aacctacgccgacttgaagccctggggttggtcagcgccagaaatggctaccaggggctagtggacgagctggccaaggacatccgcaaccagcacagacacaggcacaggcggaaggcagagctggtgaagctgcaggccacattacagggcctgagcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacccagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggattctcatcccttacagctgactcttccaggcaatttccatagatctgcagtcctgcctctgccacagtctctctgttgtccccacatctacccaacttcctgtactgttgcccttctgtcgtcttctaaaagcagctgttactcccacatctgttg

SEQ ID NO: 336700 - DNA, 282 bp, Homo sapiens
agaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccag

SEQ ID NO: 336701 - DNA, 258 bp, Homo sapiens
attgcaccactgcactccagcctgggcgacagagcgagacttcgtctcaaaaaaaaattaatagaataaaaataaaggtaatacctacctgttaaaagaagtcaaaaggccaggtgcagtggctcacgcctgtaatcccaacactttgggaggctgaggtgggcagatcactggaggtcaggagtttgagaccagcctggccaacatggtgaaaccccatgtctaaagaaaaacaaaaaaaattagccaggcattatg

SEQ ID NO: 336702 - DNA, 560 bp, Homo sapiens
gtgacatggaaaggaaaagggaggagccaaaagaacaaaatccaagcaatatgcacttcatcttgtaatacagtcaccagctgggccatcttatttccacatgcccagaccaggaaggcacaggtgccgtggggaatccagagggattcctactacaagtatttaacaggctgagacagctgatacaacaagggaaacagagaagccagagaggagcctgctgggtgtgacctactgactccaatgagccactctcagtttgccttctctgtgtatttgggtcttccaaccagctgccctcacagagggcttaggaaacactgcagctgctgcccggaactgcttatgacgcctgcaagcctggtgggtgtcaagggatggcagaccagagtggcaaagaactgtcatcgtaagggcccttgcatgttccctatgttttgaatctggggtaggctcttggaaagccttcattctttttatttttattttcttgagatggagttctctcttgttgcccaggctggagtgcaatggcccgatctcactcattgcacttccac

SEQ ID NO: 336703 - DNA, 162 bp, Homo sapiens
attcccagaagggagctctgggtcaaagggcaggtacattttaaagcctgtttgctccacattgcaaaatgccctccagaaagcatgcaccaaatgatgctgtcgtctgcatggtgtgagagtgcgcctttccctgaactctagccggttaggtagacttct

SEQ ID NO: 336704 - DNA, 115 bp, Homo sapiens
tgacacacaggtaatccttcaggaaaaatatgatactgcttcagtgctagaaaatgatgaagcacatctcaaaaagtacagaattacaagctatgtgcgtgaatatgaggaaaag

SEQ ID NO: 336705 - DNA, 297 bp, Homo sapiens
cccatccttctttcccagtggttcacattcccagtttcacctacagctcagtgcctaatctagctagtagccctccaacttgtctaattttactatcaaagctaccatttccatcttggaaacctcactgttttaatatttttcctttctaacccatgtgccctatgaacctactagttctgattccttcacctctcctccatctcagacagccaccctccactcctccagggccaccactctgggtcagaccacagcagtgatgcccctaccagtttccctacctcttgtctcatc

SEQ ID NO: 336706 - DNA, 305 bp, Homo sapiens
atttttaaaaacaacaaaaaagaaacgtaaataatcaaaaagagaacactatcttctgccccacattgtcctctttgtaagctaccaaaggacagaaagcagagaactttattctccaaaattacagatttttagaactaggagccacctgagagccagttgtggtagacacctgccatggcgtcccagcatcagcatcctttctctcttccttgtctcacagcaccctgattcatctttgggagaccaatgctcttgtactctcagatctttggatggggctaacctgctcctggctccaaagg

SEQ ID NO: 336707 - DNA, 282 bp, Homo sapiens
aggaagtaaacggttctttattagagtagacttaaaatgtggaatattctcaagtatgtcaacctttctgaacaggatgaaaaagaaacctggagcattatatgagccagtaggtcccatttattgtctgtttttttatttatcttgttctgctacccctactccttaacttttgcctggcatggacatacatctctttcctctgtccatttttcacatgtttgttcttgttagacttgggacttcagggtgaaagtgaacattattctctggtttcttcta

SEQ ID NO: 336708 - DNA, 349 bp, Homo sapiens
tgcttattcctgcctctcagtagcagatgaaccccttagtccctgaagaaatagaccaacctcagtgttcactcatggactaaacacaacatcaaactaagtaggaacaatcccatagctcaggctctgcaagattcaatacacaagtcacttcagacaacttcagttgcaccaaatgctcctctgcttcagagcattcactcagcagtgtatccctcttcagcaaggcaggaattgcccacgtctgccaccttccagacaagtctgaggcagctgatggagctgcttgctgagacccattgctgtgattcgggtgtctgtcctctccaaatctcatgttgaaatgtga

SEQ ID NO: 336709 - DNA, 495 bp, Homo sapiens
caatcatggtacatggtaggtatacaatttgggattgtcattattcttactgtgtaattgtttgtggtattgctattaggcccctatattgggaaaggtgatacacatcaatggacttgtgaatgggcgtgccctcaccacttcttttgtcaaaggataacaatgttccagaagaaggaaatttgagaaaatcaagacccctcaactctcccgaatcttcaccttgcccacaaggctttagctatttattggaacttttccacagggacccaaaaccaaactccaacacccaagcttggcactacaagccaaatctaaaactaggtcccgcaggctactactctgagctggaatgagaatctatggagaaaaacctagggatccccatcacatcacgcagggccctgaaaactgatgccaggccttctttcttcccacgtgagattatatttcttgtgtgagggcattcttgcattgctataaagaaaaacctga

SEQ ID NO: 336710 - DNA, 131 bp, Homo sapiens
tccacacgcttccacccagccccaccttttcctgattgtccaccttgtggctctcagcctttctggaatcttctcccttgtcctccagactgccaccccccactgtcgggctagtcgggggggtaccgagc

SEQ ID NO: 336711 - DNA, 328 bp, Homo sapiens
ttgtataaacaaaccaatcgccacatttagcttccccagcatgccaggttctctcccacccctgagtcctccccagcctgatagttctgcccagacacacttccctctgggcatggctaggtggagaacatgcatcgcccacatcaccttctccagaaagccttcctgatgaatctcacccacactggggttaagtttgtccatgctggaccctcacacagcaccctctgctcagctccgcagtacttcagttgttcatttggactacaagttccttaagggccaggggcccgtcttgctgcatccccaactactagcgctgtctctg

SEQ ID NO: 336712 - DNA, 256 bp, Homo sapiens
cctttaggatttttcacagattatctatataactctgggtgacagatcttttctttcacctcttggaaatgttgtgccacagctcctattggcttccatggtgtccaataagaagtccactgtcactgtaatcatttttcttctatcgatattatgtcatttctttctacctgctttcaagattgttttgtctttagttttctggggtttgattctggtgtgtgttgtttttttttttttttaattttttttttat

SEQ ID NO: 336713 - DNA, 333 bp, Homo sapiens
caatggtttgaactagaaagaatagaacctaatcagaatatgtttaccttaactatctgtatactatttgaagatggcagaaattctcacttaatattcaaaaacatactttgcatcttggcttaacacatctgtcatattgacagccttctctatgacttctctaacctactgagtaaagccaaatctgctaggaagaaaagccagaaagtgtttaatctggtaaaaagatattttacctataattcgttgaaggatacaaggaattctatacttagttttatgctttcttaagttgaacttgttatttaattctgtttgcctgtttctatg

SEQ ID NO: 336714 - DNA, 419 bp, Homo sapiens
ctcatttgcggactcttatctatgatgcaactagtttcccagacattatgctttgtcttggacagatgttggtgagtgccatgcaagtgccctgggtcaaaaacggtttctcttctcctctgcgccttgggtggatgcagggggctactcatttctcctgagccttttcctttgactatagatgacttacctgtatattcagactctgaattcaataaggttcccttgcctcgaatttgccatttactttggacatggatggaagcttgcaagcgcagagcaccatacaatgaatattttagagcacattaatggtactgttagtatagacagagggcctgccacatagtaggctcgtgaaggctgttgtctgaaaagagcttgctttggggacacaaatcaaactgtatatttggttg

SEQ ID NO: 336715 - DNA, 801 bp, Homo sapiens
cttgacctgggatttcccagttcagaactgtgagaaataaattttttatgatttacccagtctaagatattttgtgacagcagcaggaatggactaacatactgggtctagcaaagagtcctcaagtgcactgcttctctcccaccactgcctgttctcactttctttcgaagacgtgattaagtttccacatttgtttggtccctcaaaaggcaaagatgaagtacaggagaaatacatggatcacaggcaagatccaaagctggctgcagtctctgaggcctgagcctcccgtgaaggctcttgcccctccttgttccatacatctttcttcttcatagcaagacactcccattaagcccaaaagcccggaagcacactgcaacaggtaatatattacctgttgcatcactttctttgatatagtttgactctgtgtccccaaccaaatctcatctcaaattgtaatccccataatccccatgtgtcgaaggaaggacttggtgggaggtgattggatcatgagggtggttcctcccatgctgtcttgtaatagtgagagagttcacaccaagatctgacagttttataagcattcgacagttcctttttcacatgctctctcttgcctgctgccatgtaagacatgcctccttagccttccgccacaactgtaagtttcctgaggcctccccagccatgtggaactgtgagtcaattaaacctctttgctttataaattaccccgtctcagggaagttctttgttgcatgtttcccttgccttccgggatcctcgaga

SEQ ID NO: 336716 - DNA, 351 bp, Homo sapiens
tggataatgcacaccttccctgagtcagagcctgcaaaaagcaaaggaacgaatggagaaagtgcaacaagcagaaagggggctgcaaagctgcctgcctagggctacgtttcctggcaaaacttccgaaagccatttctccaaaagaaggtctagaagaggaggaggaggaggagaaggaggaggaggaggaggagcagcacagcagcagcagcagcagcagcatgaaagagccccacttggaaggcggtttggattttatttgtgtgttttgtggattctttttattttgctttacaaatgcatcttacaccaaactcatctggcattaaaaatgaattcattctcctg

SEQ ID NO: 336717 - DNA, 307 bp, Homo sapiens
tgacagagcaaatgggacaaaatattaacagtgggtgagtctgagttaggagtggcccctggtttacctctttactgggcagttagaagtctgcacagatgtctgcttcttaatctgtgcagccacctggttatcggctctgaccactaaaggacaaatgcattgtctggcacgtctcacgtcacaggtgtcaacaataataatcttcgtggtgctttctagttgaaaaatgcatttgttgtagaggcagatattttgattgtcctcattttacagatcaggcatttgaggctgatgggggcaggga

SEQ ID NO: 336718 - DNA, 296 bp, Homo sapiens
tcagcggaacaagcaaaggctagagattaccacggcctcttgcaggctgatcagcttccccctcactcccttacataaaactgttgctaacagttacccaaactgctgagccaaataatattctggctgcggtcatgttatcaaactgaaactcagcctgcctggggccttccaagtaactttcatggccagtttgtatttaaaggagaggaaagtgtaaatgtatcagacgactcaagcagctctgtttggcaactaacggagaggctagtcgcaaaggagcagggtatgcttgt

SEQ ID NO: 336719 - DNA, 166 bp, Homo sapiens
atttgtagaagattctttcacatggaaagctaaaatcttccatggacttgaggacttacttataattagcttttagtccccctgccagaacagagggaatttattaattttattatgtaagagtttatttgtttacttgtatatttgagatggggtctcattctgt

SEQ ID NO: 336720 - DNA, 224 bp, Homo sapiens
gaggacagggccaaggtctgtttgaaaacaccatctctggggaccgtttcctggattaggcacaggtggagacaggaagccagggggagaccatgggacacccccacaaagccacccaggaaacagaaaggccatgagagagatgtgggggcaccagggcaggcagaagccacagaccacaggtaccagccccaggggggtggctcatgcctgtcatcccagcg

SEQ ID NO: 336721 - DNA, 337 bp, Homo sapiens
tatctaaaatgattccaagcatatattcgacagtctgaattaaataccattttaactatctgatgattcttcactatttccattggtcaataagagttgagtatggaatatcccaaagccttataggtgagctgaacctcaggaatacagcaaaaagttcaaaggggccataaagatgctgcagcaactaaaggagctctactttatgctttataaattggagatatgaattatattgcataagggagagggggttacaggttacaataagtgttgaaaaccactgtcatgagtactcaaaataatatgtagccatgaagacaaatcaatatgaatc

SEQ ID NO: 336722 - DNA, 244 bp, Homo sapiens
tgggcaaagtgcagaactggacagaggtgtaaatgctgacgacccgggccctcagatacatagccatgtcagctactgtaaatgttaaaatgccagtatgatcactctaccactcccctccaaccagacaaggattgtaaggtaacatctgtgagcttggatattctgggaattaaacaaatcactaatactctgttctaaaaagggaccttgatgccccaaagagtaagattcagctctctgc

SEQ ID NO: 336723 - DNA, 445 bp, Homo sapiens
tatggggtagagtagtcctctcctaagagaacagacacagtgtaggaatcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttttgagacagtctcgctctgtcgtccaggcgagagggcagtgacgcgctctcagctcactgcagcctccactccccaggttcaagcgattctcgtgcct

SEQ ID NO: 336724 - DNA, 709 bp, Homo sapiens
ttttttttgttgttgttttaggttttgtattgcctttttctatctttaaaaaaatccttattctaaatgagacaaagcaatgtttctagttggttggctaccaaatctcagaatgtatatacaggatttatagaacatttataccatgcaaggttttccagtatctaatggccttcattttaccactggtagataagcggggattaggacacagtgaagagttttaagtacacagttaatggctgtgctatcttagctcgactatctgaatataaaatactaatggaataaacacagaatcataaaacagttattggccattaacactgacactgttaaaatcaacacgaagctgacagttaccagccattttccccttttaacactcttcattttgcatctgcaatcccaagcaatgggggttttttgttgttggttggttggctgagctttttttggaggggggcaggggggtatagtattctatttctttggctccagttttgattcttatgcttgtcctcttttgaattccaagtccattcgtttagaaaagaatagatctttgtgaatgttgaagatcttttattttttcccagtagttggagaaagaaaagttaaaggaggcttctagaatgatacatttacatagataaaaccttggccaatatttaagcaggggggaatgcagtacaagtgtccttctgtg

SEQ ID NO: 336725 - DNA, 342 bp, Homo sapiens
aattgctgcaacttctgttgggacagagatagtataaagagctactgagaacaagaacgtactattactatgaaaggaataaaagatcctagctaaatcatgaagatatgaattccaatatatatcattctatgtatttctgtctataagtgtgttctcacaggagaaacagatgtgaagcttttatgatttgtgattctcaaagtcatggttttcaatatttacaatgtacaccaacaagttaaaaagccagctttctcagatcacatgtttctgcaattcccctaagttgagagcagcatgatccaacatcgaattgggaggcctcagtttccttctctg

SEQ ID NO: 336726 - DNA, 286 bp, Homo sapiens
ttggttattaaagtctggaacgtggggagaagcccaggctagaaatggaaatgtgagagctacttacctgtcagtggttttaaagttgtaataatctaggtagtttgtgtaaatgtggggtgggccatggactgagccctggggaagccacccctctgaatcaattcactgcagccagagggctgaaacaaacctgaaaaccctcagtggcccctgctgccctcaggtgtaagcaggagctccccatctcggcactcaaggcctcttacaccacctggcccctcat

SEQ ID NO: 336727 - DNA, 553 bp, Homo sapiens
  misc_feature (146)..(146): n is a, c, g, or t
  misc_feature (149)..(149): n is a, c, g, or t
  misc_feature (160)..(161): n is a, c, g, or t
  misc_feature (168)..(168): n is a, c, g, or t
  misc_feature (170)..(170): n is a, c, g, or t
  misc_feature (179)..(179): n is a, c, g, or t
  misc_feature (183)..(183): n is a, c, g, or t
tccgctatgcttactcaaactttagtcaggcttctgagccttcctctaggtccatcttagagagacatcgtaaaatccagttttagcaaagagccctgctgaggcagcctatcaagaacttctgagacttaacttgctcgctctcntcntccactgaccnntgagtanantgcagcaanatantcaggaggtgatgagccttcagcgttcattgcatttactttaaatacaatccgttcaattgtaatcttatgtgcattaaataaattgtatccaaaataaatgcaacaaacaccaaaaactcttcacctcctaatcattttgccacattccacgctggggtcagtggaggaggagagccaggaaagaaacaaataataatgtaaggaaataattttagaacatttacaccacaaaaatcttcaaatgccacaaatcagggctatcccccgacaaagattctttgcttagtcaaactttagtcaggcttctgagccttcccctaggtccatcttagagagacatcgtaaaatccagttttagcaaagagccc

SEQ ID NO: 336728 - DNA, 529 bp, Homo sapiens
gcggccgctcgcggtcttgggagagctggggcgcgtgcctgaacttcccggctgcccctgtccttggagacctacctgatggggacgccaggtgtgcaggggcgtggcgcgtaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaatt

SEQ ID NO: 336729 - DNA, 998 bp, Homo sapiens
cggccgcgctcagagtctccggaacagaccggactcaatgcggaccaggcaagcggaagtgtgccgcttccttccggccagcgcagcacgagacgaggcggggaaccgcgggaggaggcggggcctagtgttgacgaacagctcccggggcctatgggcgcgggggcagccgcccggcctctccggcgcgccccctccccggggctgttgacgccccccagcccctcatttccacaaagctccgcggcggttctgccctccttgtacccgcggcgcgctgcggcccgtggcgcggccccgttcccgcctagccccgtcggcctccttcccctcccggagccgcgcgtgaggacggctgaggccgcaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggtatggagtttctttgaccattgtatcattcactcagtgggatctccagtagtaagccatgtggatgaatgaccaaggcaacacagttttgccataaagaatccaatctctagaaaggttggactatagagtgaaataacttttgtgtttattattttaaaataacatattagaatctttttttaaatttttctttattatttatttatttttgagatggagtctcactctgtcacccaggctggagtgcggtggcgcaatcttggctcactacaacctctgcctcgcaggttcaggtgattcttctggcttagcctcccaagtagctgggactataggtgcgtgccaccacaccca

SEQ ID NO: 336730 - DNA, 271 bp, Homo sapiens
aactcatgcccagatacatatctctacatatatgctacagaatcccacatggcatgaaaaacactgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggaccacagatatcggcagccc

SEQ ID NO: 336731 - DNA, 491 bp, Homo sapiens
acgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggaccacagatatcggcagccc

SEQ ID NO: 336732 - DNA, 398 bp, Homo sapiens
catttttgggaatagaaggcagctgtttctttggcatagttcatcaaagactggtttttgcatcccctgccaatgttttcagcttcagatcgtttccatgtagagcttgtagacatgctccagaaagagtacataatgtgtactccaaacaaagaaattcagtagtatgtcatcagactcttccgtcctcagcattcaatttaccagccttccgggcattgtgcctcacctctgtgccttcaatgtagagttcccagctgcctatcacctttgtggcccagcggcatctctggccacagtgccagtcctgcccctgcttgctccctgccctgtcctggcttacttcttttcttttctgagacaggatctcaactgtgtcaaccaggctggagtgcagt

SEQ ID NO: 336733 - DNA, 379 bp, Homo sapiens
atcatctctttcacactcttgtcctccatctcatcaaatgacaccaccatcttctaaaaattagaagcaagaaactcaggtggcatacttggcatccctgttcctccccaacccatctgattaattatctagccatgtttatttctccatccattaacagatggacaaaatggtatgtatgtacagaatattattcagccatgaagaggaatggaatgttgttatatgttacaacaggtgggtcttaaaaacattatgcttagtgaaataaaccaggcatggatggcaaatactgtatgattcaactggtatgaggtacctgaaataggcaaattcatagagacagaaagtagaattgaggttagcaggtgctgagggg

SEQ ID NO: 336734 - DNA, 178 bp, Homo sapiens
tagcttcgtataacccacaacacttagtgacaattctgaatttcataagtaccagatagatgttaccaatgttgaaatgtgaatgttctcttttattcctagcccagcccagcaagtaaagactatttagtccttaaagctttgtgaaaacaaaagtctaattctgtcttaaccaacc

SEQ ID NO: 336735 - DNA, 272 bp, Homo sapiens
aacttggtagcgctcgggttaagacatacactgagaaccagaacccttatctcctgatccatagtctaatccccttcctgctacagcacatcatctcaattactgcaaatgtacctgtttatacactttgaaaaatatactacttactgttcacagtcatgtgcactggcagccatgggaccgtcaccataaactaagaacaatcatttctgcactggttaattcctataagttcagtatacaaagatagcaatgcctattaacaatctgaa

SEQ ID NO: 336736 - DNA, 573 bp, Homo sapiens
gattgcattaaatttgtagattgctctgggtagtatggtcatcttaacaacattaattcttttgctccttaagcgtggcatgtctttctgtttgtgtcctcatcaatttttttcatcagtattttttggttttcattgcctaggccttttatctctttgttaaattttttcctaggtatttaatttttttgtagctactatagttgggattgcttttttgatttttcaactagttcattattagtgtatagaaatgctactgattttagtatgttgatttttgtctcctgcaactttactgaatttgtttgttctaagttttttggtgaagtctttaggattttctatatttaagatcatcttgtctgtaaagagggataatttgcctttctgttttccaatttggatgcctatttctttatcttgcctgattctaagacttccactactatgttaataagagaggtggaagtaggcatttgattcatgtttcagttcttggaggaaaggctttcagctttcccctattcattatgatgttagctgtgggtttgtaatatgtggcttatatta

SEQ ID NO: 336737 - DNA, 669 bp, Homo sapiens
tctcggtttatttatttattaagttgatcttcaatctctgatatcctttcttccacttgattgattcagctattgatatttgtgtatgcttcacgaagttctcgtgctgtgtttttcagctccatccgatcatttatgttcttctctaaactggttatcctagttagcaatttgtctaaccttttttcaagattattagcttccttgcattggtttagaacatgctcttttagctcggaggaatttgttattacccaccttctgaagcctacttctgtcaatttgtcaaactcaccctctgtccagttttgtttccttgctggtgaggagttgtgatcctttgaaggagaagacgcattctggtttttggaattttcagcatttttgcgctggcttctccccatctctgtggatttatctacctttggtttttgatgtttgtgaccatcagatggggtctctgagtggacatgctattcctgtttgttagttttccttctaacactcaggcccctctgctgcaggtctgctggagtttgctggaggtccactccagaccctgtttgcctgcgtatcaccagcaaaagctgccggacagcaaagattgatgcctgatcttccctttggaagctgcatcccagaggggcaccagccagatgccagccagag

SEQ ID NO: 336738 - DNA, 397 bp, Homo sapiens
gatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagatagaagacaagaaattaggttctagaaaaatcttttgaacacctagatctcactgtacctgaagcttgaattcctgaactttttttttttttgagatggagtctagctccatctcc

SEQ ID NO: 336739 - DNA, 701 bp, Homo sapiens
gtaaaagacctggatacaaaattatgatcatgaattacttttttcaaattgtatacccccaaaatcaccttgaatgaaaatataccagcatgtcaacagcaagttgacttctgattagaaaaaatttggaaaatttagaaggtatagataagctatgtaagttatatagctatataatgatgtttatatatatatatatgctatggagtcaactgctttgtttggactgaattatcaattatctttttaagtatttaaaaacattttaaagttaaatgatagaacctactttttataagactggtaattgtaaatgtgtctcaaggaacatgttaatactgctaatgaaatagtggtacagtaaccttttcacacagatatttttcccttcacagataatacaggaagaaggtttgagtgggcattttaaatatattttatatagaaaagaaaatttaggaccaaagagattgaatgatttaacctaaggtcttccaatgctaatggtataaagactaaaatccaggtctcttaattcttactgttacattttgaaatctgtcattccactacagttgaaaaatattaccaaatattagcaaaagaaaattactaatggccaatatgaaaaaagttcaacatagcatttacattgtattaactattataagtaatctagagatgatttaaagtatatcaga

SEQ ID NO: 336740 - DNA, 291 bp, Homo sapiens
cttcaagaaaaacatagcagttgaacggataggtcacctgaatgaagcctgcccacttgggtagcccctgacaatacctctactgtcataagttatataagatagtaagtattgatcctaaagatggtcctgaattgccaaggaagatagactccactctgctaagccagtgaccgtgatgtgcatttgaaacgcatttccttccagctgggcttggtggctcagttctgtgatcccagcaactcaggaggcggagaggggaggatggcttaaggccaggagttcaagagc

SEQ ID NO: 336741 - DNA, 503 bp, Homo sapiens
gaggcaggaactactgttaccccatctcacaaatgaggacacaaggctcagggaggttaaggaacttgtccgagatcacataggaggtggtggaacccagctgaaacccaggccacccaggacctgtgcccttaaccactctgctgctgcctctgatcaccttaatgactcactcagagcagaaaggaccagctgcttatctgggggagggctgtggggatgagatgggtggtgtccagggtgttgaggggtcaggagtgagagaatgcccttggtaccctgggcggccccttggcagctccactgaaccatggcaagagcaccctgagaggtctccttgcttccaccttgcctcaaccctgcaactccattgaagtgtaagtgagatcttgttgcacagaactctccacagttccctatcggagttctgactgcccccgcaaggcactccgtgatctggccttgctgccgccctcctaccgctgcccgctctgctccagcct

SEQ ID NO: 336742 - DNA, 194 bp, Homo sapiens
ggaggcaataaataaataaatttatttatttaaaaactgtattcaaagagtgataagtgataagaagaaagatgttagggaagtgggaggagatataaatgtactacaagactggtcaggaaagaccacacaaaaattgagtaaacacacaaaaggtttgaagaagtaatcaaaagagaatacagaggaagtgc

SEQ ID NO: 336743 - DNA, 2151 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336744 - DNA, 901 bp, Homo sapiens
ggacgcgtgggtccggacgcgtgggcaagctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagagaactgttatcggaggggaaaatcacggatgtgttggctgtgcatctggcaggtgatagagtccggcaggttcgggattgtgca

SEQ ID NO: 336745 - DNA, 750 bp, Homo sapiens
  misc_feature (689)..(689): n is a, c, g, or t
  misc_feature (697)..(697): n is a, c, g, or t
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctncgcagagncaaagtcgacgcggccgcgaatttagtagtagtagtcgacccgggaattccgg

SEQ ID NO: 336746 - DNA, 507 bp, Homo sapiens
ccaaacgcatctggctggaggcactacatacacattctccacaggcgagatgggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcaccacgtactagcacccacattcacctataagtgccccaatcgaagggatcctctagatacgca

SEQ ID NO: 336747 - DNA, 200 bp, Homo sapiens
ttccactgttagccaaaaatctcacatcggctccacccaccgctcgctggtctaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336748 - DNA, 1882 bp, Homo sapiens
ggacgcgtgggtccggacgcgtgggcaagctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336749 - DNA, 1875 bp, Homo sapiens
taacggtctaggtacgaggctgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336750 - DNA, 2276 bp, Homo sapiens
gatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaatcgagactagttctctccaagctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336751 - DNA, 1883 bp, Homo sapiens
gtgaggcctggttggaatcggccgaggcagctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336752 - DNA, 2344 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtcttaaaaaaaaaagatagaagagtaaacacagaaaaaaacttttggggccggatggggccctgagaaaggttttgtaaaacccttcgtgtgggggcggggggccccaagaggggtaggggaaatgggtcaaagggggtcccagggaaaacccggggccaggaaaaggggggggttttccccaataaaaaaacgccg

SEQ ID NO: 336753 - DNA, 2092 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336754 - DNA, 2208 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagtttggatctggctcagagtccaagtgagtttggtgcagggaggaggtgcatctaatttacaattcattcaggccctcttggactcagaggaagagaatgacagagcttgggatggtcgtcttggggagcgatactacccacctgtggatgctgacgcctgacactcgggagctggaatgctatgagatcaaacacatgagg

SEQ ID NO: 336755 - DNA, 2056 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336756 - DNA, 1881 bp, Homo sapiens
  misc_feature (31)..(31): n is a, c, g, or t
aacaaaacaaacatcaaaataacacaaaaanacaaaactaaggctaggtacgaggctgggtgttggttgcatcccggccggcgaggcattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336757 - DNA, 2237 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagatggaaaagactaaggtggctggacgtggtggctcacgcctgtaatcccagcactttgggaggtcgaggcgggaggatcatttgagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336758 - DNA, 1839 bp, Homo sapiens
taggtctagtagaggccggtgttatatgcatcacgggcggcgcgccattgacattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336759 - DNA, 1830 bp, Homo sapiens
taccttgaaggtaaaccacaggagaaaccgagatatgaaacttaagctcacacatagtgagaatagtagctaatatatggctctcaacaccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336760 - DNA, 1666 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336761 - DNA, 1401 bp, Homo sapiens
acaggtggatggggatggagatccacctcggagtacacagacttcagggggcctcctgcctggcacgttctttctctcccgtatcacctaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336762 - DNA, 1142 bp, Homo sapiens
ccgcgtacagttgcgcccgcgtaccagttgcgcccgcggtacagttgcgcaccacagacgagcctgtatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336763 - DNA, 1369 bp, Homo sapiens
  misc_feature (1369)..(1369): n is a, c, g, or t
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaactcaggggaatgtgtgtgcactgatgcatccggcaaggctgatgaggtaccgatccagtattcgggatttgcgcagagagggggtcacaccctctggcagagagcaactgcttgactcgagtggatggcaggatgaccctagatgaaggactaacgcccgacgtaggggcacaagacaagctcaggtggaaggaagacacacgcacgtggggggtagacaacgagtgcgatatataggcacggaccaacacaaggccgggagtggcgttgtcacn

SEQ ID NO: 336764 - DNA, 902 bp, Homo sapiens
tctcttatccaacatcaacatcttggtcagatttgaactcttcaatctctgcactcaaatcgattggcgggcaacttacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336765 - DNA, 748 bp, Homo sapiens
  misc_feature (29)..(29): n is a, c, g, or t
atatcactgccacctccctgctggggacnaagggaatctgacacagaagtgatcacagttgagaaatccagccctattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336766 - DNA, 601 bp, Homo sapiens
ctgtttctctaacggagcttctcctgcaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336767 - DNA, 607 bp, Homo sapiens
gccatcatcattcactagtgagtggtattacacgcagggataactggtatcacctggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336768 - DNA, 965 bp, Homo sapiens
gtgaggcctggttggaatcggccgaggcagctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaaggcaggctgcgaaaactccgggacatttgtctgcctgatgccacctgcccagcgatagtggaccgcagggactccggaaatgggcgccaagacgggtcaaccttcttgcacaacgcgcacactgcttgcctagaggagaagccaagacc

SEQ ID NO: 336769 - DNA, 392 bp, Homo sapiens
acgccagtcaacgccattacagtgcctggaatcccactcattgagtgtcttgatgttgatgaaggacacttccccgttggctccagtcatgacgccatcgtgctcacaacggacaataaggtcaatcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336770 - DNA, 356 bp, Homo sapiens
ctgtttctctaacggagcttctcctgcaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagtacaacctgccggtgagtacaacctgccggtggagtacccctgccggtggagtaccacctgccggtggagtacacctgccgtggagtacacctcc

SEQ ID NO: 336771 - DNA, 1904 bp, Homo sapiens
tttaaaaggtcgtcttgtccaatctcaaagttattttgcacagagtaacacctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336772 - DNA, 2339 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtcttttttggttggtcgaaaaaaaacaaacaacaaacaaaaaattttggggggcggcccgaaaaatttaaaattgtggggggcggggccaagtaaaaatggaagggtcaagaaacggcggaaagggggggttccaaaaaaacacggggcacggtggaacaaggtgggttgtgtacagagaacacacccgggg

SEQ ID NO: 336773 - DNA, 2319 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagctggtgactgaaggaaatacctgcccagccctgtgagcatctgaaaggcttaacttcggaatggaagtgttgaaaactcacgcacagtccagcagaggttcagaaaggaaagtgaacatcatatcacacaacctggctcatttctcttacattttttgtgtctttcagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336774 - DNA, 1820 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcaccacgtactagcacccacattcacctataagtgccccaatcgaagggatcctctagatacgca

SEQ ID NO: 336775 - DNA, 2347 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcaggtgagcggcgtgtttcataggttcctgcggccctccggagccggttcggactaggtccagccttcggggggcctcccggaagagacctctcttagtcccttcctgctgttgccgtccctccgctgggcggggcaggaatccactttcgggggccccgcgtcccgcacgctactgaacgcgggacacgaccttgtggattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336776 - DNA, 1901 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccagggtgagccgccatctccatcaccctcctggtgacaccatgtctctattccctacagtgcctgtttacgcaggctaggttgtataaactgtttcttatcccctttcgttacttatagagctacctggatgtttttttttgtcttgtgagttttttcctctgcttagttccttgctgagaaagagcatgactgtgtgtgtagaactatgttaagtgttaagaacttttctgcttattttttacgcaggaaccagttaactcccttcttccagtactttcttcatctctgttccattgtggcctcctgttgacttctgctccctg

SEQ ID NO: 336777 - DNA, 1383 bp, Homo sapiens
tacaggctaggtacgaggctgggtggttaatcggccgaggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336778 - DNA, 1684 bp, Homo sapiens
caggttacagtctaaagtggcaggatccaattacaattggagagtgactggggttagtacaaaagtaaaggaggagtaagatcaatagatggtaacatattctgaagtggtacgatccagtacagtaaccactagccataaatagctatcttacacttgaaatacacttgggtaaaattgaaatgtgcacactagatttcaatgaactggtaacaaaaaaattgtgaaatatcccatgaattaataatctttatactgattatatattgcaatgataatatctgggatatatcgggttaaatgaaacatacgtcaaggaaaaaaaataaatttctgtgcccatttcaattgaaatgggcacagaaattacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336779 - DNA, 1233 bp, Homo sapiens
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaaggcaggctgcgaaaactccgggacatttgtctgcctgatgccacctgcccagcgatagtggaccgcagggactccggaaatgggcgccaagacgggtcaaccttcttgcacaacgcgcacactgcttgcctagaggagaagccaagacc

SEQ ID NO: 336780 - DNA, 756 bp, Homo sapiens
cggacgcgtgggtcgacccacgcgtccggaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336781 - DNA, 1033 bp, Homo sapiens
  misc_feature (13)..(13): n is a, c, g, or t
  misc_feature (64)..(64): n is a, c, g, or t
ggcacccagcagntcaagcctaatgagtttgccagccagatcaacctgagcgtggagaatgccnggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactcctcacgccaagctgatcctaggcacccagcagttcaagcctaatgagtttgccagccagatcaacctgagcgtggagaatgcctggggattatcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 336782 - DNA, 1083 bp, Homo sapiens
  misc_feature (504)..(504): n is a, c, g, or t
  misc_feature (519)..(519): n is a, c, g, or t
  misc_feature (523)..(523): n is a, c, g, or t
ctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaagacggctngcagcactggacagngacnccacataccacagactaacgcaggctacacaacataagctacctccctcatcagctctctggctggctggaagcctcacacctcactgccctatacttctcccactggcacgcgcacggcactgcacacacgctacgccctctcgcgacggcctgcgcctggcactaccacgccgccgcccaccaccacgcacacgcaccgcgcccctaccccacgccgcgccacacctccgcacacctgcagcacttctggcccccagcagcgcacacccctccgccaggacgcaccacacacgcaactccgcctcagagacaacacctgctatgacaagcatctcacacccatggccagcacctcgcatgccccctacaacacagcctgacaccaacacccacgcacacacgcacgacgcacgcacaccgcccactctccagcaccgtggaccacgcaacacaccacacgcctctcccacgcaaacacaacacctctctgcgggcgcctctacgagcacgcacacaactgcgggaactccacgcacacaccccacccaggaacaaacc

SEQ ID NO: 336783 - DNA, 333 bp, Homo sapiens
ccaaaacacaccaaaaacaaaacagaacactacgcacctactgaaatactggactttatctcagcttcccagaagactacaatgcaaaaacaactactatttaagcatctttttgctcttcccaatttctaggttcccatttctacttatttaagtgtatgagacctaaataaccactggtttttttaaagcagtccttctggagggtttctacttcttccaataaccacagtgaaactaaaacatttcgaaatcctcctttgaaatttcctttaaagtctatttacaggccaggcgcagtgactctcatgcctgtaatcctagcactttggg

SEQ ID NO: 336784 - DNA, 675 bp, Homo sapiens
ggaaagacccaactccagcccactctagctatcttgcccttgctgagaaagatgaaaaaaacaaaacaaaatggggaaacacgtgtgaagttcatagttctgaggctcaggctcactacaagactgagactataggattatgaaatgcttccactcccccgacaccttactgtcacagtactaagagcctacttatagcatttccttttacccagtacatcatgtctcacaatcaagaaaaattacgaggcacattgaaaggcaaaacatgacaatttgaagatacagagccagaatcagaatcagacatgataggaatgttgggattataacaccagtaatttaaaacaactatgattgatatgccaagtgctataatggataaagcagacagcatacaaaaccagataagaaatgtcagaagagaggtggaaatccaaagaaaataccaaaaagaagggatagagattaaaacaaacaaacaaacaaacaaaaaaacactgtagtagaaatgaagaatgtcgttgatgaacttatcagtagactcaacatggctgaaggcaaaatctatgagcttgagaatttagcaatagaaaccttggaaactaaaaagaaagagaacacaggctgaataagatggagtggagtatccaaagactgtgggttacatatatt

SEQ ID NO: 336785 - DNA, 1780 bp, Homo sapiens
ataaataaaatccatatttcctctcatacagaccccagagttgctttgcctgacagtgtagttgatggagaaaataatctttatccttagcctccatctggttgcagaccataaagacagggaaaaaatgagggtgttggtagcttcgttagaaactgaaagctcactgattttttcaaaacctaaatagcctgtgtttctccaaataactaatttgcagccttcggcagccaggactggcagggatggggctagggggactggggagaactgctctctcctgagggtggtctgacccgacagcacgcatgaccttcccacagtcaggaactgctcagagacgtgatggcaactccatagaatgaaatactcttcagccagtaaaatgtatttttggataaatatttgctttaaaaaactttactatatgttgttaaatgaaaaaaaaaccttaaggcatcagaaattatgtgcagtaaaatctcacttttgtaaataaatatacctgtttactacgtatgcataaaaagaatcctgagaaatataagtactgtatgcatattgttgttaagtattttttctgtttgcttatctataattctaattttgcttcaaagaaaaagttactccggcaatataaaaataaaataactaatttgtcttgtcatcaaacagatagtaagaacaggcaaacctggccctccacactgccagccttttgtgattcaaggcttcagtttcctccacttgttaaaaagattcaacaaagtagttgaaatagtatgtgaaccagtaaaccctaaaaggtgtccagtgttgtctgtgagctaattaagtgatttgattctgactccccgagtcttctgatttcgaagcagtggggagtcagacaggagcctcaggtggcctctcctgagaggccctggaaagtgatgagaacctggcctctggcagctcttcataaacgtccatgttttccctctactctctcactcttttcccagggcctcaaacagaagatgaaaatcaatttctaaaacagccctctgtgtgctctctcgtatctctccttttcacacatcgtggtggtggctttctctgtgttcctctgttgattcagtctctggaattaacggatcaggattccatgcccagaatgctacaaagactgtgcttgagttctcccacatctcactcaattacacagaagtttcagattatgtaacagatgctgtgctgggttaggcagagccatctgacttgttttgctttattttagaccatgagatgggtgagtttttctttttaatgccacattcttttaagaattaaaaacctccacttggctgtcagcattggaaatcagagtgatggtgcaagccctgatgaggacaatgtccttgtctatgaaaaggtgaaatcattgcttgaaatcgctaagcaggacatgcagtcccagatggaggggggaattcgggagctggttggaaaagagtatttggcactttgcagccttgagaggtgcagaagagacaccgaggggttcaccaccagagccaccattgtcagagaggcgtccagctgtgtccacctgggactctgccttcagggcttcttgcctggctgggagctgcacaggcagactcctgggacggtgtgccgacagctctgggcacccccttctaggatctgattcctgaggaatcacaatgtggatttcacaatcacttccagtgtcttttgccaacctctgtgaacagatgtgcaattaaaaaaaaaa

SEQ ID NO: 336786 - DNA, 363 bp, Homo sapiens
ccccttttttggcactccaaaactcccactctgtcagttttcttacaaaaaatgttctttcttttgtgtttgtgacaaagattgtgtaggttaaatctcttctgtggagcaaggctaatttcctgtgttctccctttttctgctttctggatcctgctctggttttcctttaagcgtgttggtcaaaaattgaacaagaaatctttgttgatagaagctaacatttccaatattcagctttcctaaattattacattgccagttttttttttttttttttttttttttttttttttttttttttttttttttttttttttttttttttttttttttttttttttttttaacagggcggacaaa

SEQ ID NO: 336787 - DNA, 511 bp, Homo sapiens
tatcacttcacaatgtcctcaatgccagaatctcacactttaatttcactttctcccctcacatttcactttacaatggttttttctatcttttaaaaactataccgtattactgttaaggggttttaacagtatttagtcaatatcagtttatatttattcacatatttaccctttttattattcatcatttggatggttccttatggggatatcttccttttacctgaagaactctgtggtggctgttgacttgttctgttagtgttttaattttagaccaggttgctggtaatgattttcttggtttttatttctctggaaataatttttttttttacattgaagtttgaagaatattttgctggatatttagaagtttaggttagctgctattttcctccaacagtttcaagatggcctccactatttcagttgtgaagtctgccatcagtcttattgttgactcttttgaaagtcatgtcatttatttctcaaactcttttttttt

SEQ ID NO: 336788 - DNA, 407 bp, Homo sapiens
cctgatctgtaaaataaggataatagctacataatagggctgttttggtattaaatgggtttatatgtatgcctggtacataataggcttgatgagtccttaccatttgtttcaattatctaatgctatggaataaaccaccccaaaacttagtgagttgaaacagtcattttatttatttttcattcagtgggatgataggctgagttggatagttcttgtggttttgtggtttgtcatgcagctgttaagtcaggtgcagctgaggctggaacgtgtgtgatgctttgttttgttttctttcttttttttaaggacacctcgagaccgttgagtaagtgctttgttgtagtcaggtggcaactggggctggaagatgtgtggtgctttggagggtatggctaaga

SEQ ID NO: 336789 - DNA, 287 bp, Homo sapiens
cctcctataagcaccttttcctcactcaccttcagccacagtgttctccaaattcacttatcccattcctgcctcagaaccaccgcacctgagtagaatactctccactcagatacctacaagatgcttccttacctaatgcaagttctctgctaaatgtcacctcagaaagagggattccctaaccactctaagatagttctcaaggtgtagcatagtggataaagaggctatttttttgtgtcatagaggggacacaaaatatgtatttatatttgcttgaggtg

SEQ ID NO: 336790 - DNA, 322 bp, Homo sapiens
agtaggatcagaacactgcagatcaaaaacatggcaaagtgggggaacacacacagcacacaatgaaccgtggaagtgggagagggaacaccagtctcaggagtgaggggcctgggggacaacactgacttcccttccccctagccacacccggtctctgactggatacttctcctccacccatgtaaacgccgggagcacccgggcttagtcctcggccttcccttcatctacatgctctccacaaaggagctaatggggaacctcagtttcacgaagtttaaacaaaaaaagatatctggaaaactctcaggctgacgat

SEQ ID NO: 336791 - DNA, 562 bp, Homo sapiens
gggactctacttaggtcctgtggcttcctttctccaaaccctggaacagcagcccaggatgaactctagcctgtgagacccttctgtgtgcccccgatctttgcagtcttgtctttcatgagatgtgcagggagtctgtggagcatgtgcttcgaatcaagccacctgtgatttgcaatcgggccatcgcactgttctgagtcgcctgctcctcttccaggaagcctttccctgactggggaggatcccttcctctttaaaatcctgccacttgcttcagactctccctattatatttccacttcctggctgcagtcatcagaattcgggttttattgcatccccttaaagacaagggtcatctgttgtatagctttctgtccccagcacctgacagtcattccgttggaaaaaatactgatagattgcttcttggacttttggctaagatcaagtagagaaacagtgatggagacatccctgaacttgcacaggaggactgaggccatgagtctgaaagaagagactgctcagtgacagattgttggctttgccaagggtg

SEQ ID NO: 336792 - DNA, 524 bp, Homo sapiens
atacatcatgatagtgacatacagtcgtgctgagtccatgatatgccactgacacctcctacatccagagacttcagaagctcacaggaatgcaaaggtcggcatgataaagagaaggttccacagagagcgacaagacatcaacccaccatgcctgcctgagaggagcagcaggaccgctgtaaggtttcttgtttctgtctgcagcatgggggggctccactgcccgaccctaccagctactagatgccattcaggtgaggcttaaggaggctcctgggctgagccaggctgtacaccaccctccctgtcccatgggacatctgctcagcaccacacaacagcgaccaagcaagggagatccaaacacaggtccttccaagcaaccttccacctcttccttccatcctctcttcggttcccagcagctccctccacagatccagggaaagaaggaggaagaagtgtgcgttaggacctgggatttggggtctcacgtgtatccctcaccagctgcaggacat

SEQ ID NO: 336793 - DNA, 414 bp, Homo sapiens
tttggccgggcatggtggcttacgcatgtaatcccaacactttaggaaactgcgggggggaaggatcacttgaacgcaggaggctgaggctgcacgtcacagggagagacgggccgcggtgatgtatgagcttcctgttgataggcagttaagttggttcgggataacgtggcctgcctggcacgggtattcccagagtcacagatgctcacccgtgccagcgtttggctgcttgggacatggggacggcgaggtccccacaccccacatgtgagctgctggtagctgggctgagcccaggtcccatccgtgtgtggggcgtgagtgtgcggtgccatcgggtctgcacgggcctcgcctcgtcccggacgctccaggcttcctgtggcacgggtgccgagagggaccagcctg

SEQ ID NO: 336794 - DNA, 136 bp, Homo sapiens
ttgtcctttttcatctcaattttgttacttaaaaacaattcttggcgttccttccagccacatttccttttaattctcagcttattgtgggcatgaagacatgatagcctttcttcagcaacaacaaaaaacacaa

SEQ ID NO: 336795 - DNA, 114 bp, Homo sapiens
tcacaaagtccctgggtggtttccctgataagcttccagccatctatcttgtataagaatttgttatttacctgcaagtaatttggggtacaaacttctacagtgagggctcag

SEQ ID NO: 336796 - DNA, 366 bp, Homo sapiens
aacccctgcatactatacaagacaaccatccccaagacacatagtcatcatattctccaaggtcaaagtgaaagacaaaatgttaaaggcagctagagagaaagggcaggtcacctacaagggaaccccatcaggctaacagcaaatctttcagcagaaaccttacaagccagaagagattgggggattgggggcctatattcagtgttcttaaagaaaagaaattgcaaccatgaattttatatccagccaaattaagcttcataagtaaaggagaaataagatccttttcagataagcaaatgctaaagaagtttgttgccaccagatctgtcttagaaggggcctttaagggattgctaaata

SEQ ID NO: 336797 - DNA, 402 bp, Homo sapiens
tcttagtgacccgactctttgattcctgcttcctcttcaccagcctgctccatgctgaccgggtctaggatcctgtagagcacctgatgctcactgacctgtggctacagaacactcctttctctttaaaaatttcgcaatgtatttgcccccctctagtctcccagcctctctcctgatgtcccacctttctccaacatctctggcagggaggggtcagtgatttcatttacaagatctctcagcatgtggggaggtaacttgtccaggtcaggaaaacgtgagctcatttaaatcttcaaggcaatctctttactgatcttggatctaaagtccctttaagccaagaaaattctatacctttccttctaaagatcatgttctggacaggaaggtagagca

SEQ ID NO: 336798 - DNA, 465 bp, Homo sapiens
gcggtgagctgagatcatgccactgctctctagcctgggcaacaagagcgaaactccatctcaaaaacaaacaaacaaacaaagaaacaaccatcaactttgtttctgtaaattttttttggaagggctcacccttgaatggttgggtgcttggattttgatttctgatacattcgggcttaattctcggttgtatggtttcctaactgtgggactttgggcaagctacctaggggcgctgcaatttataggaatgatggtgtctctgtcagagggtcgttgggagaatcaactgggataatgcaagaaaagcacttatttgcatagtgactcgatggtggacagccattccatcaataactaacgctccccgctggctgagtcacatttcgtattgcactaaagggtgtttctttcttcctgcgctcaatctggcgcacatcttgtgtcgttcagtaccgaaac

SEQ ID NO: 336799 - DNA, 363 bp, Homo sapiens
ttttaatagtgcctttgctcaacaaaaatgtagctgttactggcccatagggctgcttcttagaaagactggtgtggaaagactggcttagaaagactggctgtgtggaaatgccagccttggggcggaaacctccatgagatctttttaaatgtggaactagaacaaaacaaaataagacaaaacaaaactatgaggttacagcatcaccataaagatctaaggtatctacaaatatcatagcttggtttcagtgacattaccaaaccaaactggagtgggcttgcccagcgcagtaaggccaaacgttcataccaaagttttatagtgggagaaggaaggggattgattagcaagacacca

SEQ ID NO: 336800 - DNA, 389 bp, Homo sapiens
ggagaggagaataagctggttatagaccctcttgcttctggccctggcccctaagtgaactggcagtctggtcagggactccatagcggttgggctttccgaactctgttttgagatatcttgtactggaaatcagggacaatggtgtggtggtagtggtggtgttgatggggtcgtgatgttcactgctgtatctctgtctagcacctatccaagaatagatattcaggcagttggttaagttaattattcccattaccctcagcttggaatcacgaagagtaaaggtgttggctggaatgtaaaggggtgaaggcttggtagtagccttgcctttcagatctgaggataatataggaaatgggggatgtcattcataggcgggtttc

SEQ ID NO: 336801 - DNA, 293 bp, Homo sapiens
tcaggctggagtgcagtgatgcgatcatgggtcactgcagcctcgacttcctgggctcaagcaatcccctcccacctcagcctcctgaatagctgggactacaggtgcatgccaccaagcctggctaattaaaaaaaaaaaaaattgtaaagacagtcttgctatgttgcccaggctggcctgaagcaatcctgccaccctcagcctcccaaagtgctgggattataggtatgagctactgttcctgatttcacagaggctttctgaggctgggccgtgcaccccagcagtgg

SEQ ID NO: 336802 - DNA, 860 bp, Homo sapiens
tttatttctcgtgggagaagtgtgtctcctctttgtctcaggcacccctctgccctgtacagcagcaagtcagcaggaatgagctgagccgcccaagtagtggctccctccactatgggggctctgtggtcctgggggctgtcctgcctccactgccataggcctggccccagagcatgctgcagtggtcacaacctgtggaggtgcccccagacccccatatttgggcccaactacagcctccttccccagctttgccacctggcttgggagccagggcaccaccagcttcgttggcagggagagatgaagaaagaggccatagccacgcaagtgactgaagttcatgttcgtgcacaccaattagagagggacagcacgttcatttacctccaaatccagccacagacacatcgcccttttctcttggctctgaggcctccacagaagggtttttttaaggttgcagccaggacctttatagcctagtcctgagaagattatctttttattgcaactttgattaatgattgatcaaaaactgatactagaaacactgaagaacaaatttgctgtagacattaggaaaggtctacatctggcaggcctggagacctgcccaccctctccccccacggtcaaaccagggcaaaggtacattggaagacccaacccctacacactcttacacgtgcactcgcacacacacactgaggggaaagaaatatttaattgtccttaaatcctcttggattaggctataaattgcaaataaatggagcaacaagagcaaaactccatttcaaaaaaaagtttttgcagtagttgtacgccagctgttccattagcccaaaaaacaa

SEQ ID NO: 336803 - DNA, 223 bp, Homo sapiens
caatttggggtgaggtcacataggtttggggtcaacccaaggattaaaataacaatctagaaggttctggaaggggctgagtatgaagacagaatactagaggccgggctcggtggctcatgcctgtaatcctggcactttgggattacaggcgtgagccaccgtgcctggtccagtcttctttttttttttttttgggagaccgggactctcgctctgtcgg

SEQ ID NO: 336804 - DNA, 338 bp, Homo sapiens
ccttttgttttctctctcatagtgtgaaattgaccaccttacttctgtctcctttaactcttacccccctgtgagaccacaataagtactgtaaactgtgtgaagtataatgactaacgccaaataattgggtttatctgctcaagggaaaaaggtgcagttgaactagaagtacattaagcctttcactcctgaaggaatgtgtttattctggcaagaattttccagtaaatttccattaagatagcatgtgcagaaaaatgcaaggtcattgagtaacaccattgttacataaatacaccatctatatcaagccttgctttcaaaacatgcataaa

SEQ ID NO: 336805 - DNA, 171 bp, Homo sapiens
ttctgccctccttggggtacccctatcaggcccgagacacaccctgtgctcgaaacagtgttgccagtgtccacggggcccagcgcaggggctgatgggaaggcattttcgtgcatgggggacacaggcccccccttctccgtggcgcttttttttttttttttttttttc

SEQ ID NO: 336806 - DNA, 145 bp, Homo sapiens
aaaaattacagtagcaactttgaaactatgtaaactgtacaaattattaatgttatctcttcatgggtaagtccatcttttccttgttttaaagttagaggaagcagtttatcagctagaatttctttttttttttttttttttg

SEQ ID NO: 336807 - DNA, 438 bp, Homo sapiens
ataaccatatccagatctggtttgtataggtgactgagataacctcagcctcatctcaggaagtggccacttttggagagtccgactatcacggtaggcacagaactctgccatgtcactagctgaatgacctcggatgtcacttcaactctgagccttagaacttgtcaactgcaaagtggggcacttcaccgagctacatcattgagctacttcactgagctacttcattgaattgggaaaattaaaggagcaaatatgggagaaggatttggcccatagtaaacactatgactgtccgtcttctgccatctttcagtagacccagtggaattatatgaaggttgataggcacttaaaccaagaatatatgaacatctattctgtgcaagatgtgtgcattgaactcagtccaggactgaaggggacaggaggaag

SEQ ID NO: 336808 - DNA, 461 bp, Homo sapiens
atggagatgactggctctggaagtccctgttctgaacagttgtacagagggatacagacaaggggaggagactgggggcacccagctgctactcctgcatgtcatcccctgaccacagtgtcctctgaactaactggtgattatgctggataaaattggcatctgggagaagtgagggcaggtggtgttcatctgaatgcaggagagtgtagagtgttttctctaacaaggctaggtaagtcatcttcaggggaggggcttacaaggactcattggggaagcgacccctgtgtatgcaggtggctatgctaagagctggtgatagagcagggtgtctcggtggagggctccctctcggactcagaggcacattttagagcttcattgctggtggctgaaaagcacagcttaggtccttctgtgtatcttatagagatgaaagtaaagggcatcgggaacca

SEQ ID NO: 336809 - DNA, 169 bp, Homo sapiens
ggaagaggggagcagggggagcccagcaggagggagaaagagagagagagaggcagagatacagagagatatatagagatgactgagacagaaggactgagagagataggaacagagatagagagacagaaagagacagagatagacccagagagagtctctgaaagga

SEQ ID NO: 336810 - DNA, 683 bp, Homo sapiens
  misc_feature (11)..(11): n is a, c, g, or t
taaatcacaangagggataaaccaagtggatggcaaactggcccccgttgaagagctgctgcagtctctgcttggcctctttgctcagcttcaccatggcgatggccgtgtggcacagggaggaccccttacagcaaccaccgcatcgggaatccgaaagggagaagttatttttatttttacttatctatttatttattgagacggggtttcaccatgttggccaggctggtctcgaactcctgacctcaagtgatccacccacctcggtctcccaaagtgctaggattacaggccatgagccactgcgcccggccagcatagtttcttttcaaaactcatccaagtagtagcatgtgtcagaatttccttcctttttacggctgaatagtattccattgtacatatgtatcacattttctgtatccattcatccatcagtggatgcttagatggcttccaccttttggttattgagtggacagtgctgctacaaatatcgagggtgtgaatatccattcgtgtgtctgctttcggttcttgggtttatacctggggtgtcccttggcttttgctgtatgatcgactcctgctggggatttctgggattgccctctttgttacctttctgttttagcttctgggagaatcttaggtgtgtccctaggctgggctttgtgacc

SEQ ID NO: 336811 - DNA, 265 bp, Homo sapiens
acagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctt

SEQ ID NO: 336812 - DNA, 440 bp, Homo sapiens
agacggggtttcaccctgttgaccaagctggtcttaaactcctgacctcgggtgatccgcccgcctgggcccaagtgtttggattacaggcgtgagccactgcgcccggcctggaggtgcacttcaaacagccttgcagtgaagtcctgtacttgccagaccagtttttgggccccatccccatgctgagcacgtggcagtcccatcagctacccaatccttctccagatccctaccagagttgttacagaggtcaacttcattcctttctccaccttgcccatccattagttcatttgttcacacaatcattcagcaagtactttctaggcaccagctgtgtgccaagcccatgccagcctcatgctaggtgctaggtgccaagtttccagagatcagcgttacttgaaaatgcctacacagctgacaggaaaaacaga

SEQ ID NO: 336813 - DNA, 838 bp, Homo sapiens
gtagcagaagctgactttggccacgtgaggcagagccacctcctgaatatcagaggtgctgaggtagcccctggataataagacccatgcagaattgcgaagcctcactccaaccttaatttcaaacagctcagtcagtcaatcaatcaagtacagtatttcttgaacagcttcatgtagccggagagctcagcatggtgctctgctgcataggaatcccatcagaaggatatgtccatgctgtcattgtttgtgtatgtttcaaggacttgcaattatgtgatttggaagagcacattatagatttattaatcaaaactgaccgaccaggtatcatctctgctccttctcttaagccctctgtacctgtgcaggtgagcagtgaaggacagggttggggtcaacaggagggggctcctctgttcatctcagaggtgtctgctggtccccagagaatcagacgtttcccttgtcatacatttgccactccctggaactgacttcttgaggagtctctaggttttaagacataataatttttttcaagtgttatctgtgagattttatggtctgttgcatgctaagatagaaacttgacttttctttaactttttgttcctcacttactgctaggcagaataaatgagtccttcagcacagttcctttctccctaggcttgtttactgctttatgatattcatgtgtagtattttgatgaaatgtatttgcttctcaatagtttttaaatcattcgtgggcttctcccttttacttacctctcgtttttgtctgtctgtctgtttgtcgttatagccatcctggggtctccagctagtg

SEQ ID NO: 336814 - DNA, 225 bp, Homo sapiens
tatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctggg

SEQ ID NO: 336815 - DNA, 493 bp, Homo sapiens
ttgcaaagtgcccaagcacaccacagaatcctatgtctggaaggaatcctgagggagctgtctctctccagggttaacacataagaattctctatcaaaacccccagatgaggtcatctagcctctttgtgaacactccacaagggggaacttactaccttcaacataatcactaagtgagtcaacatgaaggactgcagtaactcaagagggttgggtgggcagtttgaaggcctccatgtgaatatcaaggtagatgctatcaactctctagactgggagctggcaagcctcttcattttggagccagtggcaggcctaagaaaaaagactaaaaaaaaaaaaaagaaaaaaagaaatgaaccaaaaaaccccaacaaattaagcgaactgatccagaaaactggtgggaggatcacttgggcccaggagtttgagaccagcctgggcaacaaagtgagatcctatctctacaaaaaatacaaaatttagc

SEQ ID NO: 336816 - DNA, 255 bp, Homo sapiens
ccaacgctcaacagagatttcaggtgggttggaagtccagggtggaaaccatttgccttagattttctaaggcagcactccattccttccagcttcttgagttgctatggagaggtccccagtcattcagattcccgatccattgtacatgacctggtttttatcagaaacttgtaaattttctccctttgcccagtgttcagaaattccacactgacctatctttgtgcggcttttcatttcttaccactcagt

SEQ ID NO: 336817 - DNA, 455 bp, Homo sapiens
gtgagggcacagcattcatgtcctgttgcccttcccccctctgtcatgtgaggatgttgttgcaagaagatgcttttactggaacagaccctcaaagaagctgccagtgctttgatcttggacttgctcgcctccagaactgtgagaaaaaaaaaattctattatttataaattacccagtctgtgttattttgctcttgcagtacaaaccaggcagaccaacctacctgtgcctaggtggtccgcaaaaaaatgtagccttcacagcagtgttcgcagagccagcccacattcatggattcatagaagtctaagtcctggcaaactgacagaagagctatggcattgggagagtgggaatctaaattttagatgagatagctaaggatacctcaattaaaatgtgacattgtaggcaaagatttcatggctaagacttcagaagcatagacaac

SEQ ID NO: 336818 - DNA, 426 bp, Homo sapiens
gggttgctgtttagacgagtcactgttcatggtgaagaaatgattaggggtatagggaccactgaagtagttgctagaagttccgagtgagagaagagggatgtctaaaccagggagggactgtagggaagtgccaggatagcagatgcaaggtgccaggcagcaggaagggtcaagggtttccagcttgcacaatgatggtgagggaacaaaggaggaggaaaaagggcctcctccttctccacttagaattccaagtgcccatgtgccacccaagtggagttatccagtgtgtgctttatgtaattggctatctgggtttcaggctccagagaagtgataggctgcggagagagccttgggaaaagcccatttatgattggaatggtatccatggaaaatgaagaggaattccttagtccctcc

SEQ ID NO: 336819 - DNA, 228 bp, Homo sapiens
atgtgtttccctgaacatttgccagacaataaccctttaagattgtgcccgtggagagttatatagaggaagaaacatctggtttctttcggtgcctaataccatatcaaaacacttggtctttaatttagaggagatcaaacaagaagactgtttaactttgttgattatatcagacttctttgtgataatttatgttttgatttctacctcagagcaagggaaaaa

SEQ ID NO: 336820 - DNA, 565 bp, Homo sapiens
aatgtcagtgtgctttaatttgttcactcatgctggattctctgcttccccctttgctttgggcttctgagaattatttccaagcaaataactatacctccaagattcccaaagccactcagaaaaaaagaagccacaaggatgcatttttttatatgaagtgacttagctgtgtaaaaagaagcactgttttaaaatcccacagagtatctttggacacttatgtaaaacttatatgtaagtattttagctgaagactgagaatcaactggatttatggggagatagtcctctcttttaagctgttccatgcttactgtacatctcccagatcagtggggtaacttgtattatgttgtgctgtgttatttatccttccacgaattgctgcaaaagctgtgttctgggtcatccccacaactgctgtgaacaagggcatgccttgcgaggtggcatgggttaaggaccaaggcttaggaccccacagggcagagaggcaaactaggcttatattagtattaaacctgtgacttgagactgcatcatattgcttcattcttaaaga

SEQ ID NO: 336821 - DNA, 191 bp, Homo sapiens
aaactgacttacgaaaagcaaatcatactcaattcctattgagatgtcagtcaaagcccgagatctatctttctctgcaagtgttactgttaagcaacacctgcaccaagtgtaatggaacagatgaacctggggatcagggtacaggactttaagcaaacaattaggaatttttttttttgagacagagt

SEQ ID NO: 336822 - DNA, 350 bp, Homo sapiens
caagagggccagggtctaaagccaccagtggctcaacccatgcgccccggacagccctagctccacatggctttagctgggggaactcaggatgggctgcttcccgaaggacacctgcagagggaccagaagagcactttgtgtccttctgggagtcccagggaacctccgagagcctctctgcttggggctgttatttgttcacatgcgtgctggagcacttaccataggatatggtgatgaggggcagagctgtttaccataacgtccttgacacagggtgggaagcagtaaatgagtacatgttttttaaatgaacaaacaaatgaataaatgaacctaaatctctg

SEQ ID NO: 336823 - DNA, 912 bp, Homo sapiens
tataggtgcccagcaaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaactggagcacccctgaggtaggactctgtgttccaggtgccctcatcctgctgtgaggtccagcacaagtatcccagagaatccacgaatcaatgtcagcttgagcgggagattttatggaagttgtacttactactgatattaaaaaatgcgtaggctatttggaaagatgattagaattcataggctatctaaaggattattagaacaactcaatcttgagttaggttggctaaattgtaaacatttgtctatgtaggacatatgtcgattagccagatatcatttagttggaatacactgttttgtgaacctcttggggaagggagaaacgggcaagatagatattatttcagttgtcacccgaaattgaaaatacatattggaatgtacatttaatttcacactcttattgaccatgacatcagagagaggtgcaggg

SEQ ID NO: 336824 - DNA, 815 bp, Homo sapiens
ctgggctttgcttctgccatccatgggcactgcctgtgtgctgggctcaggtgccagcctgggggcttgcagcacggcatggctgcccccggaaggccccaggcgccaattctgtgcaggctcacgaggtggtcaggagtgagcccgagggaggggcagggatagtactccaggcagggagctttggggatctcagggtgggtggggcctctggggtccccggcctggctccttcccagtagttggggtcaaggttgttgagagagtgggtcgggtcctacctagggaagtggggggttttctctggctgctctgcaggaagccactgggccatggagtgcagatagcagcctcgcagtaacccccaccaggctgtgcaccctagcacagctggtcctgcctggtgagaggggaggttggtggcccaggccagcgttggcctctggcctctgtccccacagggcctggtggcccctggctggtgagagccctgacctcttagatcctctgaatctggacccctgaccccaccttcacggggttgaggtctgcagagtagaccgtgattccagttcctgttggggtcagtcctcctgtccccagacctccctggcccacgactgagcctcccagcgggctctgtggagggcctgagctatgctgcctgcagcgctggcctctggcccctggcacccagcacatgggccacagggccagctcctcttgctggccttggctctcctgctgtttgaagctccagctttgatttcctcaagcgttcgtccagctagaaagttctctgaaacggctcccta

SEQ ID NO: 336825 - DNA, 577 bp, Homo sapiens
ttatatactttacatgtccctctctctgatcctgtcactaatttttccaagtagatatctatccctatgtttaaggaaggggaaaaaaagcttaaattttttgcatgtttcatgctttgtgtagatttagaataaagtatctggaggatttttgaaaagttgttatcaaacgaaagaagctggcaagtaccctaaatacatttaaataatattctccctgctgaatggatggcattcatatacaaacttaaatgaaagcagatgcccatcacaaaaagaagccactatggttctccagagattctcatataagtgctaaatctgatttcaacttcaaaagaagatatcagaagctatcagcctccgcctctgttcatcctccacctctcatacggaattaccagacctaaagagccccaggaacaattttaatgttcagcattaaaacattagtaatattagataagcattacttatccaccaatttctccatactttaaaaaaatttaggcagaagcaattcaactggcatgggaagatgtagagccattaataacaccttcacttagcctgcaaa

SEQ ID NO: 336826 - DNA, 162 bp, Homo sapiens
agagggaaatggagtggcagaaagaaaggggacagtggccacctcaagggcaaaggaatgggaaacaatagccccaagcagggaataaataacaacttgttggcagaagcaaaggaaagttaagggaactaaggcagagatttgccatggaatgccctcctg

SEQ ID NO: 336827 - DNA, 353 bp, Homo sapiens
ctgatgacccattcaaccttcttctcatgctgattaataatgatatattactttactccctaaactatagacccctgtaggaaaaaataaaagtaggcacttaatcaataggactccagcaaatttttttcatataacatactcgcttttgttgttgttgttgttgttgttgttgagatggagtcttgatctgccacccaggctggagtgcagtggcacgatctcagctcactgcaatctcacctcctgggttcaagcaattcacctgcttcagcctcctgagtagctgggactacaggcatgcgccaccgcacctggctaatttttgtatttttagtagagacagggtttca

SEQ ID NO: 336828 - DNA, 418 bp, Homo sapiens
catgcaaaaactattcacttgagaaatatggtgaggaaagcaccaagaaaataaccaactgactgggtgaagtcgagggaagtcccgccttataatcagtgcttaggatccccatcccctatgacctttcccccaaactgacactttctctaaaatgtccattcccgtagctaaaacacaggtaacatttccttgaaattcaatacaacaaaagttcattaaccaaaactgaaggaaatactgaaatgagattgcacctgtgggatgatggttttaatctacatataaatttcaattgttttaaaacccaaattgattaacggtactacagttcccaaggaaggcttcaggtaagatgcttatcattcgggtttctgcgtgggactaacaggttactagcagctcatgggcagcaatg

SEQ ID NO: 336829 - DNA, 1131 bp, Homo sapiens
caggttagttcctaccttttttgtcattaacctagtttttaaaatctattttgtgctgccttgtttctaagaacacaagaaactctaaaataaaaatagtctttgttttgtgtaccatctgaatatttgtagatacattaattgagtttcgtttttctttaacaggttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacagatttaatcacaaatcattttttatgaatgattgagtgaaaatagtgtttataaaggttaataaatttcttgacaaaaaaaaaatgcactgctggagatgaaaaacagtaggtctttgtccatgttaagaactgaagaaggtgtatgctctttaacatttgagtagttccaaaaacgttatccaaaagaagtttcaaatcaagggattaattaaacacttgtatgagattttggtaaaatacatttagaagggatttttgggagggcctctaaattacatgaaaattgtgatttttatgtgtcatgacatcacaaattatatatctgtaagaatacagatgtgtaaaaaaaatccttttagcacttttaaaagattatacattgtttgctggtgacatgcaaaaaggaggcagatagaaatgtatatagattaaaatttaggactaggtttaaatgtggtgtactttttgtttacttcatattcagtttaacccatgaaacattttcaaatgggtgtctgttcagtatcctctggctttgaaaaactgactacatccccctgtgcttgcaagtgcctgctgccagaggccctccccttcctttcctgcttgtcctgtgtctgctctgatgtttgcggtggcagctttctagg

SEQ ID NO: 336830 - DNA, 483 bp, Homo sapiens
actaacattattacatatattggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaaggtgctgtggattatttttaaacttaagaacagagtgtactttaatttctacagataaatagatggagagctactcgtgagttggtcattatattttagttcttgttcctcttttcagaaactataaggtagagactgagtcccagtatcaatgacataagctttttggttcctttctttgctttcatttctttgctgttctgtgtatcagagaatctttgatcaagaagtagccacgtggagtgtgcaagcaagatatcggtgagggaacaagacagcaggaggccagtgacctattgacagagccagatagctcaggagggca

SEQ ID NO: 336831 - DNA, 2639 bp, Homo sapiens
atacgcatgcgtgcacgctgccggtcgggctgggctgagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacgatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggagatcatccaattatgatgggttttgaaccccttgtgaaccagaggctacttccacctaccttccctcgatatgcaaaaataattaaaagggaagaaatggtgaactattttgcaagattaatagatagaataaaaactgtctgtgaggttgtgaatttaacaaatttacattgtatcctggattttttctgtgaatttagtgaacagtcaccatgtgttctttcaagatctctgttacaaaccactttcctggtggataacaaaaaggtctttggaactcatctcatgcaagacatggtgaaagatgcacttcggtcttttgtcagtcctccggtgctttcccccaagtgctacctatataataatcaccaggctaaggactgtatcgactcctttgttactcactgtgttcggccattctgtagtcttattcagatccatggacataacagggctcgacagagagataagcttggtcatattcttgaggaatttgccaccttgcaggatgaggcagagaaggttgatgcagcgcttcacaccatgctgttgaaacaggaaccccaaaggcaacatttggcctggttaggtacctgggtcctttaccataaccttcgcattatgatacagtaccttctaagtggctttgaattggaactctacagtatgcacgagtactattacatatattggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaagttcgcccattgagccgagagatcacaatgagccaagcatatcagaacatgtgtgctggaatgtttaaaaccatggtagcatttgacatggacggcaaagtacgtaaaccgaagtttgagcttgatagtgaacaagttcggtatgaacacaggtttgctccattcaacagtgtgatgaccccgccgccagtgcactacttacagttcaaggaaatgtctgacctcaataaatatagccctcctcctcagtctcctgaactgtatgtggcagctagtaagcactttcaacaggcaaaaatgatattggaaaatattcctaacccggaccatgaggttaatagaattttaaaggttgccaaacccaactttgtggttatgaagttattggcaggaggacacaaaaaggaatctaaagttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacagatttaatcacaaatcattttttatgaatgattgagtgaaaatagtgtttataaaggttaataaatttcttgac

SEQ ID NO: 336832 - DNA, 1284 bp, Homo sapiens
ccgttgtcagtgtatgagtggatagaaaatgtagaattctttaataattagaaatgggattttagtgttgttcatattaaacgtgttttgaattatacttccccttctttttaggaaatgtctgacctcaataaatatagccctcctcctcagtctcctgaactgtatgtggcagctagtaagcactttcaacaggcaaaaatgatattggaaaatattcctaacccggaccatgaggttaatagaattttaaaggttgccaaacccaactttgtggttatgaagttattggcaggaggacacaaaaaggaatctaaagttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacagatttaatcacaaatcattttttatgaatgattgagtgaaaatagtgtttataaaggttaataaatttcttgacaaaaaaaaaatgcactgctggagatgaaaaacagtaggtctttgtccatgttaagaactgaagaaggtgtatgctctttaacatttgagtagttccaaaaacgttatccaaaagaagtttcaaatcaagggattaattaaacacttgtatgagattttggtaaaatacatttagaagggatttttgggagggcctctaaattacatgaaaattgtgatttttatgtgtcatgacatcacaaattatatatctgtaagaatacagatgtgtaaaaaaaatccttttagcacttttaaaagattatacattgtttgctggtgacatgcaaaaaggaggcagatagaaatgtatatagattaaaatttaggactaggtttaaatgtggtgtactttttgtttacttcatattcagtttaacccatgaaacattttcaaatgggtgtctgttcagtatcctctggctttgaaaaactgactacatccccctgtgcttgcaagtgcctgctgccagaggccctccccttcctttcctgcttgtcctgtgtctgctctgatgtttgcggtggcagctttctagg

SEQ ID NO: 336833 - DNA, 399 bp, Homo sapiens
aaggactgtatcgactcctttgttactcactgtgttcgggtaagagctacaatttggattgtcataatgggtactttaaaaatcatgggctgtggccgggcacggtggctcactttgggaggctgaggcaggtggatcacctgaggtcaggagtttgagaccagcctggccaacatagtgaaaccccatctctactaaaaatacaaaaatcagcgtatggtggcgcacgcctgtagtgccagctactcaggagcctgaggtgggaaaatcgcttgaacccaggaggtttcagtgaaccaagatcgtgccactgcactgcagcctgggggacagagtgagactttgtctcaataaccataataataataataataataataaattgctggactgcaattc

SEQ ID NO: 336834 - DNA, 475 bp, Homo sapiens
ataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggtaagatttcgtaatgtaagaaatccttggccaggtgcggtggctcatgcctgtaatctcagcagtttgggaggccaaggtgggcagatcacctgaggtcaggagtttgagaccagcctggccaacatggtgaaacactgtctctactaaaaatacacaaaatagccaggtgtggtggcatgcatctgtaatcccagctacttgggaggctgaggcatgagagttgcttgaacccaggaggcagaggttgcggtgagctgagattgtgccactgcactccagcctgggcaacagagcgagactctgt

SEQ ID NO: 336835 - DNA, 726 bp, Homo sapiens
atacgcatgcgtgcacgctgccggtcgggctgggctgagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagagatttcgcggctcctagaactgattgattttcatgaatataattttaaaaatgaaaatgttcaatgttggaaggaatg

SEQ ID NO: 336836 - DNA, 3217 bp, Homo sapiens
atacgcatgcgtgcacgctgccggtcgggctgggctgagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacgatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggagatcatccaattatgatgggttttgaaccccttgtgaaccagaggctacttccacctaccttccctcgatatgcaaaaataattaaaagggaagaaatggtgaactattttgcaagattaatagatagaataaaaactgtctgtgaggttgtgaatttaacaaatttacattgtatcctggattttttctgtgaatttagtgaacagtcaccatgtgttctttcaagatctctgttacaaaccactttcctggtggataacaaaaaggtctttggaactcatctcatgcaagacatggtgaaagatgcacttcggtcttttgtcagtcctccggtgctttcccccaagtgctacctatataataatcaccaggctaaggactgtatcgactcctttgttactcactgtgttcggccattctgtagtcttattcagatccatggacataacagggctcgacagagagataagcttggtcatattcttgaggaatttgccaccttgcaggatgaggcagagaaggttgatgcagcgcttcacaccatgctgttgaaacaggaaccccaaaggcaacatttggcctggttaggtacctgggtcctttaccataaccttcgcattatgatacagtaccttctaagtggctttgaattggaactctacagtatgcacgagtactattacatatattggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaagttcgcccattgagccgagagatcacaatgagccaagcatatcagaacatgtgtgctggaatgtttaaaaccatggtagcatttgacatggacggcaaagtacgtaaaccgaagtttgagcttgatagtgaacaagttcggtatgaacacaggtttgctccattcaacagtgtgatgaccccgccgccagtgcactacttacagttcaaggaaatgtctgacctcaataaatatagccctcctcctcagtctcctgaactgtatgtggcagctagtaagcactttcaacaggcaaaaatgatattggaaaatattcctaacccggaccatgaggttaatagaattttaaaggttgccaaacccaactttgtggttatgaagttattggcaggaggacacaaaaaggaatctaaagttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacagatttaatcacaaatcattttttatgaatgattgagtgaaaatagtgtttataaaggttaataaatttcttgacaaaaaaaaaatgcactgctggagatgaaaaacagtaggtctttgtccatgttaagaactgaagaaggtgtatgctctttaacatttgagtagttccaaaaacgttatccaaaagaagtttcaaatcaagggattaattaaacacttgtatgagattttggtaaaatacatttagaagggatttttgggagggcctctaaattacatgaaaattgtgatttttatgtgtcatgacatcacaaattatatatctgtaagaatacagatgtgtaaaaaaaatccttttagcacttttaaaagattatacattgtttgctggtgacatgcaaaaaggaggcagatagaaatgtatatagattaaaatttaggactaggtttaaatgtggtgtactttttgtttacttcatattcagtttaacccatgaaacattttcaaatgggtgtctgttcagtatcctctggctttgaaaaactgactacatccccctgtgcttgcaagtgcctgctgccagaggccctccccttcctttcctgcttgtcctgtgtctgctctgatgtttgcggtggcagctttctagg

SEQ ID NO: 336837 - DNA, 2162 bp, Homo sapiens
atacgcatgcgtgcacgctgccggtcgggctgggctgagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacgatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggagatcatccaattatgatgggttttgaaccccttgtgaaccagaggctacttccacctaccttccctcgatatgcaaaaataattaaaagggaagaaatggtgaactattttgcaagattaatagatagaataaaaactgtctgtgaggttgtgaatttaacaaatttacattgtatcctggattttttctgtgaatttagtgaacagtcaccatgtgttctttcaagatctctgttacaaaccactttcctggtggataacaaaaaggtctttggaactcatctcatgcaagacatggtgaaagatgcacttcggtcttttgtcagtcctccggtgctttcccccaagtgctacctatataataatcaccaggctaaggactgtatcgactcctttgttactcactgtgttcggccattctgtagtcttattcagatccatggacataacagggctcgacagagagataagcttggtcatattcttgaggaatttgccaccttgcaggatgaggcagagaaggttgatgcagcgcttcacaccatgctgttgaaacaggaaccccaaaggcaacatttggcctggttaggtacctgggtcctttaccataaccttcgcattatgatacagtaccttctaagtggctttgaattggaactctacagtatgcacgagtactattacatatattggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaaggtgctgtggattatttttaaacttaagaacagagtgtactttaatttctacagataaatagatggagagctactcgtgagttggtcattatattttagttcttgttcctcttttcagaaactataaggtagagactgagtcccagtatcaatgacataagctttttggttcctttctttgctttcatttctttgctgttctgtgtatcagagaatctttgatcaagaagtagccacgtggagtgtgcaagcaagatatcggtgagggaacaagacagcaggaggccagtgacctattgacagagccagatagctcaggagggca

SEQ ID NO: 336838 - DNA, 1279 bp, Homo sapiens
aggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcagactttgaagactgtctcattttatatctttttctcgttattcctagggtcaagacgttttgggcaagaataaggatgtgaacatcagaaagctcataacattttgtttttgatgctaagtttaacaaaggcatgctttagtagcctgtgggccctagggtttgttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataag

SEQ ID NO: 336839 - DNA, 740 bp, Homo sapiens
gtccgtgaggtgggaagtcgagtttagtttcgttagtttaggatgtgttaagtttgagatgctgatttttcagagaagttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataag

SEQ ID NO: 336840 - DNA, 132 bp, Homo sapiens
tgtggggaaaggggctgtgggaacctatgcagaaagccagggagggggtgatttctatgcagaagggacagataaaacttccaactgacaacttgtaagaccttcagaagggaaattagccagaccctggag

SEQ ID NO: 336841 - DNA, 565 bp, Homo sapiens
atttgcgcaagttaattcatgcttggagctttaatattttaaaatgattcagacatcaatcaagcaaccagaatttatcacaaaatctgtaagatatatagtttctagtttacattctcgatgttgacagctttcctcgcccaaattattgcatctgatccacactattattgtgtgtggtaagcatgtcaggcattatatccattttagtaaaggagaagttgagtcaaggcattaagtggcttgcacaaggttatatggctgttaagtcatagtcaggactataactgaaattttctgactcctcgaccaatgttctctataccaatgttttcaaactctgttatagaaggaactgaaggaggtgacataatatgaaatgaggacaagagaggccatcttagatgaaatgttttatttatttaaaaaaagatgctgcccttttaagtaaaactttgaaaatcattgcactgtattgtcgccgtttttgttttgaaatgggagtgctaagtcagatttgtcaatggtaactccaaaaagggataagaaaaagtcatctgttcct

SEQ ID NO: 336842 - DNA, 236 bp, Homo sapiens
atgccaagaattccacacctaatctcaacataaccaccttaggggctctgcctgtggcttccagaccatggaagtggcgtgggggaggggagacaggaaaatccttgaaaagcagcggacatgagaactgctccgtcgcacagggccccatgctcaggacactacacatggtttaacactgtcattgccagcttgaaattcttagtaatttgattttttttttttttttttttttt

SEQ ID NO: 336843 - DNA, 247 bp, Homo sapiens
caaggaggcaacccaggctgtgtgcagcatcgccccttccctccaaggcaggctgggggccagatctttccctggctttggaggagcggagtgcctaaatcatatactaaatcagagattccaaagaggggtgtgtgtgtgtgtgtgtgtgtgtgtgtgtgtgggagacggtgtctcactctgtcactgaggctggagcgcagtggtgagatctcggctcactgcagtctgtggtcccaggctcaag

SEQ ID NO: 336844 - DNA, 303 bp, Homo sapiens
cttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtacc

SEQ ID NO: 336845 - DNA, 579 bp, Homo sapiens
tcgctttattaatccttagggaccacatagagctgaaggcttgtttctcttcactgtggcaattaaatcctattactccttgacttcttatacatgcactgagtgtgcatgtaatttggcccttcccaatgataaaatgcagaggtgaaacacggttgctgtgctgtgaagccactctgtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgctgttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggagaactcagacttagcggtatagaggatacacagttcgcgaggagaact

SEQ ID NO: 336846 - DNA, 434 bp, Homo sapiens
aggagaagaggaataaggaagagtccttgaactaggaaattagagggttttaagtgagatttcatccctgtcaacatcaatgaccagcgtggatgccacctgatactgagagccctcagtattcaaaacacatctaagaaattctggacagcacagagactaccaaattttaaaaattcaacagtgactcaggacacactgaacatagctctgggcaccattcggaaataaacactttaaccataagtgtcaaagggcatgtgtgtagcccaggcccaaagaccagacaaaccaatattgtctcacagaaacccttttccacctccccaaactcccactccccacttgctgccttcttagtcgcagccatcactcacttcaagcaaagcagtgcacagaatatcacagtctaaatacacaacgcccttaaaaaa

SEQ ID NO: 336847 - DNA, 422 bp, Homo sapiens
aacacatttttctaaaataagtgtgggttttgagagtagaaactacagtttaaataagttaatttgatctagccaaaggtacttaccaggatttttggctattttcttaatttgctcaataggtacttagtgcctactatatgtcaggcactatgcctggaactgtggcaaagaaaggtcagtaagatagggttcttctccccaagaaatactgaatttgttgggggaaacagacagatgtgttactgacagaatataaaagttacctgaagaagcacacaggcacaaatggatgccatgtgtggaatatagtacaaagaggggtttactttctattgagaggatcaggaaagaccttctagagaagatgatgtgtagaacctggagaaggatgaataagactttgggagaaaggatattct

SEQ ID NO: 336848 - DNA, 445 bp, Homo sapiens
tcacacctttggtaaaacatctctggtcagggaatataaaagaatgtagaatctgcggctgaataatgatttctatttccatagaacatacacactcaacacaactccctctttgtggggaagcccttcttctttctcagtgccagcgtgtaccctgctgtgggatcactgctattccttgatctacaaaaaaaaaaaaaaaactcttttccatcacatacatctcatgaatctcagaactcaattttactctttaaatatttttaaagctgaaagatttattttcacttaaaaacaaaaagtcagtcccaaagtcaagagttcacctggtgtcaaagcaacattacctcctttttctgcatctctctccccgttttccttcctacagctcatctgagtccgaataatgttcttaaataagtcttctcactctttccccacaaat

SEQ ID NO: 336849 - DNA, 293 bp, Homo sapiens
ccaaaatttattataggactgtagtaattaacagaggttcaggggtggaaaaatagacctgtggaacagactatagagcccagaacagattgataggtacagatccatagatggaatctattttcagtatgctatgagataggactgttaattttcttcactccaactcagattagcaattgaaccagtaccacagtgaatagtttgtcctttcctcactagtttatttcttttttaattttttttttttttgagacagtctcattctgtcacccaggctggagtgtaggggt

SEQ ID NO: 336850 - DNA, 96 bp, Homo sapiens
agagagagagaagcattgcctgatgtaagatggggaaggtgaagagttcagggaagccagagaaagactcacccattgctcaaaagttcaggcaac

SEQ ID NO: 336851 - DNA, 543 bp, Homo sapiens
tgtctcaactgttcctccctgaccttgaggagagtgctacacctaattcagagattgatgtggggggttctaagaggttaaatgactaggctaccagcgcagagtttgaaactcctgtctatagtatcttaccttgtgttatgacacctgaaagggaaactctaagcttagagaaaaatccttttgatatgacaatctcaataaagactgtttatgactgcacaatacgttgtaatgccaaaaggcaaatctcacaggaaaattccacatacagacaagcaataagaactggtttgtttcgtaactaacctgcatcttgaggaataattcaggacaaggacaataagtgccataaccacatcaccttaagaagacctatcctaacctagtaccaagaaaaggttaagagcgtcagcctctgaaaaaaaggcataaacccattaggagccctggaaagagcagttgaggggaaaacggaatcaaaacactaagacaggtggccacactgcctgaaggctgggatgtctgagacagcagaaccat

SEQ ID NO: 336852 - DNA, 89 bp, Homo sapiens
atgtactgtcattaaccagtgctttggggaggattcgttgactaggatttccaaaactgaaaatcattgattgataacgtaaaatgata

SEQ ID NO: 336853 - DNA, 476 bp, Homo sapiens
gcatgggaaaaaaaaataaaaaggcatccagattgaaaaagaagaagtaaaattatttctatctgcagaagacataatcttatatatagaaaattctaaaaatggcacaaaaaactggctagagctaataaattcagcaaagttggagaatagatcagaacacaccaaaaaaatccactgtttttctacatattggagctgaaaaatatgaaaaggaaatttagaaaacttcatttccaatagcatcaaaaagaataaaatactcaggagtaaacgtaaccaaggaacaactgtatactgaaaacaaaaagttgctgaaagaaattaatatgaactaaatgaaaagaaatcacatgttcatggactgaaggacttaatattgttaagatggcaatattccccaaagtgatctatagattcattatattcccaaagtttcaatagctttttttgcagaaatgaaaaagccaacccta

SEQ ID NO: 336854 - DNA, 307 bp, Homo sapiens
ccaaatcacaggctctgtaacttttctcattcttgtctttctgtgagtctccaatgtcaggagaactgcctctcctgtgagctttgtgccttcctgttgtgtctgtcatccttctccccagcatggggcaattggtgtccctctgggagttttcagatagtaatttgcccatcttggaaggaaatggtctccctttggcctccttacttttctcagggtgtctgttctcttcttgcaaatgtctagactcctaagactattgcctccacagcctggaacttttaatgctaatattgtataatctggt

SEQ ID NO: 336855 - DNA, 914 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgcgtcactggggtggaatgtcctgggtctaagtctgtggtcgtatcgcaagctcgaaaaggaaaggtaagaattgcataactgggttaatgtacactgtgagtttctgtactaaaatattgatataaaaaaaaaaatcgggttttggggtggggaaggtttgatgcatgggatgtcggcatttgcacgggaatcgggccaaggggtaatagggacga

SEQ ID NO: 336856 - DNA, 814 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagaatccgcgtcactggggtggcaggtcctgggtctaaggtctggggtcgtatggcaagctcgaaaaggcagctaaaactgcctaacgggtatggccggggtccggcttatatggtttaaaaa

SEQ ID NO: 336857 - DNA, 645 bp, Homo sapiens
  misc_feature (499)..(499): n is a, c, g, or t
  misc_feature (501)..(502): n is a, c, g, or t
  misc_feature (513)..(513): n is a, c, g, or t
  misc_feature (543)..(543): n is a, c, g, or t
  misc_feature (551)..(551): n is a, c, g, or t
  misc_feature (556)..(556): n is a, c, g, or t
  misc_feature (572)..(573): n is a, c, g, or t
  misc_feature (581)..(581): n is a, c, g, or t
  misc_feature (587)..(587): n is a, c, g, or t
  misc_feature (605)..(605): n is a, c, g, or t
  misc_feature (624)..(624): n is a, c, g, or t
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagcttggtntnnttttttccttnccctgttgtcgtaaaaatgggggtcccttnacttgaanttttnaaagggaaagggaaannctttgggnccgttnttggtcccccaagggaanggaccctttaaacccaatngtttggcctttaacaacaagg

SEQ ID NO: 336858 - DNA, 909 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgatttaaaccaggtttcaacccccaaggggcccccttgggaccccggccaaaaaccaggcttaaattcccaggcttggcttttaaaggcttggggccccaaccaaaaggttaacccaggaacccaaggaaggaaacaaaaaaggcaagaagaaggaaagcccagaagaacttggttgggccccggggccggaagaaaaggaaaggcttggctgtggccaaaaaggggggacggttccccaaaacggaaaggaagaaagccaacctggttcctttcggagccaaggaaggtttaaccaacccgccaaccaaaccttggcggtgggaggaaaccaggaaaaagcttcaagctggatgggggaagttgggcccaacggaaagtggtgtggaattccccccatttgcggaggcctgtgcgtttgggcctcctcccttgggccccttgtgacccccgttggtttgtttcggttaccactgtggggggggttccccttttacttgtggctttttatctccagggggggaacacaggcgcaaagggcacctgtggggaaccgttctctttacgtttcgcccaccaggtgaagggacaccctgtggacgcccaacttggtgttgtcggccctttatacaccaccagctgttgtgacactctcggggaaagcaccacaacagggg

SEQ ID NO: 336859 - DNA, 727 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggcaagaccaaaggcgctttgggcctaaaagcttgggttgggaaaaggccctaaattcccaaggggggaaacccccaaaaaatttttaaccaaatggacagata

SEQ ID NO: 336860 - DNA, 321 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcaggacgttggatccagtcagtgcggcgttggatgcagtcagtgcggcgttggatgcagtcagtgcggcgttgatcgtcagtgcggcgttggatgcagtcagtgcgcgtgatcagtcagcgctgaggcctat

SEQ ID NO: 336861 - DNA, 399 bp, Homo sapiens
acatacaaaaaaggagccttgtgggaggtcagatataaacaagggggagtggtagtaccacaggttttctttagtgatactgggagcttgatggactggctcaatgtgaatttctactctaagtaatttttaacaacagattaagaagccaccttttgtccctgacttactgcccattttctgagctccaggatccagactattgctctaattcctagttctacttggacataccagttcttcactatcttccctattcaagataatttcttccaaagaggctaagggaatcctatagccagatattctttatttaaaaaacatacacaatgtttgatacaggtggctattgatacatgctagggattttacttgatctcaaagacttaaataagagac

SEQ ID NO: 336862 - DNA, 422 bp, Homo sapiens
gtgggttgtctctagtttttttgctatcataagcaattccgccatgaacattctcatacgtctcctggtatacaggtagagcagcttctctggggtagaaaactaaggtgggatttctggggcatcaggaagaatatcttcaaccatattaaatattatgcaaagtcactgtcctcattttacattcttgtcagaaatgtgtaagaattcaggatatttcaaatcttcagtaatgctgagtaaaagcgcaagttacatgatttcacacgtgacacaagacttcaattagacagttcaattattaactacattaatactgtagactgtatagtactgtatactgtatacttgaaaattgctaagagaatagattttgagtgttctcaccaccgaaaaataagtaaggtggcatgcaaaagttg

SEQ ID NO: 336863 - DNA, 207 bp, Homo sapiens
cccagatctgctcagactacactaccacctccttgaacatttagctcagcatcacctgcaagtcttcctgaaggttaaacagagagcctagctctctagcaacagtcttgagataagcctaagcatctggaccgagaagggcactcatcacagcacaactgatgtagccaacagcaagacttgcaagctgttactgggtgtagcaag

SEQ ID NO: 336864 - DNA, 232 bp, Homo sapiens
ggctgagatttgatctcgttttttcactactgtgcctcacggcctaaaacagtgcctggcacaaagtgggtctttattacatatgtgtgggatgggggcataaattcccatcagcctccagcctcagtttttcaccaaatcattgagctctgtgggtcccctcatccctctaggccatcctagagattaattcacttccagtgagagctctctggctgccgttagccttgta

SEQ ID NO: 336865 - DNA, 177 bp, Homo sapiens
aatgagggaatgtcacagaagaaggcagggaggacacatggttgacaaagcgatagttgtgtgatggaagttgtcacagtgaccatcttaactaacccaccaaggtagcatcctgctaccaagaaaagataatggcctcttgacatggtaatgtggtagaacagtgggtgacagatg

SEQ ID NO: 336866 - DNA, 100 bp, Homo sapiens
  misc_feature (93)..(93): n is a, c, g, or t
ctggacacagctcatatacccaccagttggagactggatcaacaaataggtatagtcataaatggaatacaacttagcaatgataaggaacanctgtctt

SEQ ID NO: 336867 - DNA, 195 bp, Homo sapiens
tgcttctgcagatcaccaggaactccaggaaccttagtaatggaactcaggtgtcttcttctacgactccttcttgaccctgagcactctcttgtgttgacctcagcattgctgtatgttcctggtctccccttgtccctaaaagactcttcctcctctctctgttctctggcttttctttctccttattccctc

SEQ ID NO: 336868 - DNA, 392 bp, Homo sapiens
agctacctgcttaaaggattttttttttccagacagggtcttagtctggttgcctactctcaagtgcagagtgacgtgatcttggctcactccaaccttgaattcccaggcgcaggtgattctcctacctcagcctcctgagtagtgcacatcaccatgccctagaaagtttttcagagtttcactctcttgcccaggctggagtgcagtgccgtgatcttggctcaactgcacctccacttcccaggtcaagtgattctcatgcctcagccgcccgagtagctgggattataggtctgtgccagcacacccagataatttttgtacttttagtagagaccgggttttgcctgttggccaggcttgtttcaaactctaggcctcaagtgatc

SEQ ID NO: 336869 - DNA, 1096 bp, Homo sapiens
ttccttttcacttcgactccttcctagcatggcacacgatagatcatttgatcattagaaaggtaacttctgaggcctcacacatggaaatatattgaataatttctagcataaatcaatgtcccaggcttatcattttctttccctgtctcagttcttgaatcagccaattttgcaaggaccctggttcctttacggaaggacaggatttagaaatcagtatctaggcacttggtgtgttcattattactgcagtgccttctagtctctccattgagctgagaaatatgtatgtgtgtatctatagacatgtggagatcaatgtatatatatggagatctctatgtatgttcataggttagaaaaaaccatgaggccagaccaatatttccaattctaatccaacacctcaaagctctttctagcctcacctttcaatatttgtaagttccttttccaactgtgaggaaacgtggctctcattatactcactgttttgttcgtttgtttgtttttgagacagagtcttgctctgccacccaggctggagtacagtgacctgatcttggctcactgcaatctctgcctccgaggttcgagagattctcctgcctcagcctcccaagtagctgggactacaggcatgtgccaccacgcccagcaaatttttgtattttttagccacagtgctgggattaacaagcttgagccaccgtcccagctgttttaaataacgtaaataacagtgctgagcagtaagaaaatgagatccagcccttgttaacaaaccgacaaagcctctccaattgggtttactttcctctccagtcttcttctcagaagtcactctggctcttgtcagacatcctttttcccccaagtctcaatatatcggtgctctttactcggcttgcccagtgtactcgttgaggtgtcaatccccctacacttgggggatttctgggtcgaagattcggccaggcggggctggggggtcggatcgccgggactgtatcacgctcggggtacgcgtactcaggggcgcactggtgagtgtgtggcgcgacacaaggcggtggtgggtggtggtcgtcga

SEQ ID NO: 336870 - DNA, 971 bp, Homo sapiens
ttccttttcacttcgactccttcctagcatggcacacgatagatcatttgatcattagaaaggtaacttctgaggcctcacacatggaaatatattgaataatttctagcataaatcaatgtcccaggcttatcattttctttccctgtctcagttcttgaatcagccaattttgcaaggaccctggttcctttacggaaggacaggatttagaaatcagtatctaggcacttggtgtgttcattattactgcagtgccttctagtctctccattgagctgagaaatatgtatgtgtgtatctatagacatgtggagatcaatgtatatatatggagatctctatgtatgttcataggttagaaaaaaccatgaggccagaccaatatttccaattctaatccaacacctcaaagctctttctagcctcacctttcaatatttgtaagttccttttccaactgtgaggaaacgtggctctcattatactcactgttttgttcgtttgtttgtttttgagacagagtcttgctctgccacccaggctggagtacagtgaccaagatcgcgccattgcactccagcccaggctacagtgtgagactccgtctcaaaaaaaaaaaaaaaaaaaaaaaagaagagaaaagaaatatagcatctcttcaacaaacggttggggacaactggatttgcacatgcgaaagaatgaagttggattcctatccctcaccatgtaaaaaaaatcaactcaaaatggatcaacgacctaaatataaaagctgaaatcacacaactcttagaaaaaacataggagttaatcttcatgaccttggatttggcaatggattcttagataggacaccaaaaggaccagcaataaaagaaaaaaacagataaattggacttcgtcaaaatttaaaactttcgtgcacaaaggacattataaataaagtaaaatgacaacctatggaa

SEQ ID NO: 336871 - DNA, 407 bp, Homo sapiens
ccactgtgcccggctggcagtcagtatctttttaagggtgtaatgtgtaagttggacacatgactttcactcctattgtattggcaagaacacagtcacatctagttgcaagggaggctgtgaggtataatttctagttgaagaaccttgctaaattttagccttgctaaaattgaaggtggaatggcttaatgctaaatgggggaaatggagaaagaatactggagcttttagtcatctctgccacctagaataatagagaggtcaaagttcagcagtgtgcacccaaacctccattttcttcatacctgacaccatgttgcagaaactgaaagcttgcaacctgagggctaagactaatccattgcttgagataattctatccatgtttagcagtactttaaaag

SEQ ID NO: 336872 - DNA, 1017 bp, Homo sapiens
gtgaggtgaagttagggcagcgacgattggccgattactgaagaggcatgccacttaggctttctgaacctcagtttcctcattcgtaaaatagaaacaagaatcctgctcttgcgccccctcccgggattattagaagattgaatcctaaaaaaaaagaagaagaagattgaatccttttatggatttgagggtccctggctttataaatttaaaatatttaattctttcagccagcctggattatttgctcccttagagcccatagatttactgtaattgattcagtccactccgatttttctcgcccataagtatttttatttaaaaatgaatatatcttatcttcttcaacgaagcacttttgcagccattacgtcttttcggagctagacagaagttactaaacctggaaaattccttaaggatcacttgcttcaaagggagacacggtggccctgctgttcaaggagcgtcagtgacccagagagtcagtgaccaagaggaaacgcctgtctcctggggacttccaagatactagctacagtctcttatatttacacctttcctccctaaggacagcaggaaaaagaaagttccgtgtttctttttaaatcagggagatgttaatagctacatggctcattttgtctacaccacagaaataacagtggttccagttaatcatgctcatgttgagggggagtgcttatgcaggggccaccagaagacccctctccttcactaccaccaccaccaccctaagaaatgaaaagccaaaaaaagaaaccaaaaaaccagaggtcaacaagaagcttccagaggtagtcagcaggggacaagaaagtgtttttataaaaaacgcacatatctttgatgacaaaaaaaaagggatagctatgaaggaaaaatgaagcaaataaaaattatttaaagcatatatttacttaaagcataattttaaagtcatttaaagtatgaaccataggaaagtgttgaagaaaaacatttaagaaa

SEQ ID NO: 336873 - DNA, 241 bp, Homo sapiens
ggatgtgatgagctactggagttgctattttgcataaaatggcatttgagcagaggcctggaggtaggctgggagcaagcccatcccaaggagatgtgtttcagaaagtggaatggggagtaccaaggccctgcagctggagaacactcatcaagtttgagtggcaaactggaggccggtatgttgaggggtggggaaagaaaagaagggccaaggactggggagaagctcaaagggtgtg

SEQ ID NO: 336874 - DNA, 471 bp, Homo sapiens
ggctgggcagatgggcacagaaattttcagggtatgacagctaaagggtgtttttgaagaaaagagtttttgaaggaaagagaaagttctaaaatttatcaggtgatagttgcacaattttgtgaataaactaaaaaccactgacttgtacactttaagtgaattgtatggtacaggaattatatctcaataaagctgttacactcaccccaccccgccaaattgagatagagattgaaatgggcacagaaatttgcagatgaggaaattgaggcccagaaataaagtaacttgactgaaggacagctaactagaaagtgggagaacaaagactccaccctggcacctgggctccagagttctaaagaaattttcaaagaaattcaacaccataaaaagcactccatgatccctcagctcagccaaaccgaatgcgtctaagcaggtaactgaatttctgtgcccatttaa

SEQ ID NO: 336875 - DNA, 1290 bp, Homo sapiens
ggctgggcagatgggcacagaaattttcagggtatgacagctaaagggtgtttttgaagaaaagagtttttgaaggaaagagaaagttctaaaatttatcaggtgatagttgcacaattttgtgaataaactaaaaaccactgacttgtacactttaagtgaattgtatggtacaggaattatatctcaataaagctgttacactcaccccaccccgccaaattgagatataatttctgtgcccatttcaatgatatgggccagaaattttatttctataaaaattactacatgaactaagtctaaatcaaacaaaaatgccttcctctactttgaaacaatagtcttctctcataaacattttattcaaatatttcccagcaacaggcttgtgtgcactaaccaggaagtgaaaccaaatatgatcatattgtgaaagcagagtaaaatgaaagaacacaattggaattatctgaagcattattaaaatttcatctgaaaatccaattcccttggaaacaacaatttaatcaaggaagtaataaaaggaatttcaaaagcataattcttcattttcttgtgtggcagtgtccccagtcttctatgcaaatatcttttcctgtagccaggctggctcatctgaaacacaagctttcaccaacccgcctggtgaatacagggagcagggttaagcaatcattttcatgctagtaaatcaactctggtataaacgattgcaatctttaatgacttactttggagaaaaatgtatcttttgcttcttaggtaacaagtaaatcacatttctcttaattatttttctgtggttactgtcattccctttaatctattgtaaattataagctctctaaaaccagaaaatgtattttactgattagtctgcttttaactgactcagtaacctaaacatagtgagagttattataagtacctaaagattattcttattgtctaaggatagtgttagcaaacaaaactcactatggtttacatttttctgctaagatggatactaagtaggatcatgaatttctgtgccatttcacatccacacaaaactcacagaaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatcgttgtgaaagtagtatcagtatatgacctttaatttctggcccaatcagggccggctgagt

SEQ ID NO: 336876 - DNA, 1078 bp, Homo sapiens
ggctgggcagatgggcacagaaattttcagggtatgacagctaaagggtgtttttgaagaaaagagtttttgaaggaaagagaaagttctaaaatttatcaggtgatagttgcacaattttgtgaataaactaaaaaccactgacttgtacactttaagtgaattgtatggtacaggaattatatctcaataaagctgttacactcaccccaccccgccaaattgagatataatttctgtgcccatttcaatgatatgggccagaaattttatttctataaaaattactacatgaactaagtctaaatcaaacaaaaatgccttcctctactttgaaacaatagtcttctctcataaacattttattcaaatatttcccagcaacaggcttgtgtgcactaaccaggaagtgaaaccaaatatgatcatattgtgaaagcagagtaaaatgaaagaacacaattggaattatctgaagcattattaaaatttcatctgaaaatccaattcccttggaaacaacaatttaatcaaggaagtaataaaaggaatttcaaaagcataattcttcattttcttgtgtggcagtgtccccagtcttctatgcaaatatcttttcctgtagccaggctggctcatctgaaacacaagctttcaccaacccgcctggtgaatacagggagcagggttaagcaatcattttcatgctagtaaatcaactctggtataaacgattgcaatctttaatgacttactttggagaaaaatgtatcttttgcttcttaggtaacaagtaaatcacatttctcttaattatttttctgtggttactgtcattccctttaatctattgtaaattataagctctctaaaaccagaaaatgtattttactgattagtctgcttttaactgactcagtaacctaaacatagtgagagttattataagtacctaaagattattcttattgtctaaggatagtgttagcaaacaaaactcactatggtttacatttttctgctaagatggatactaagtaggatcatgaatttctgggcccaatcaccatatctctta

SEQ ID NO: 336877 - DNA, 605 bp, Homo sapiens
gaggggagaagatattggctatcacagaacctcaattttcacccactaaacaagaacaataacactttcctacttccttcacaggatgggtgtgaggattaatttaggccaggtcaattataaggaactatacagaaggtattttttgcagagaaggtcccagctttaaagctgaagctatatttactctaaggatttggagaggtcactaaagtgtatgaggcaggccaaggaagactggaggagagagtggattctagaagggaatcaatccaattgggtgaatggaggactaaggtgagctcattgtccaggaccaatggatcaatattagtgggtggggtaatcgtattcatagtatgctagcccctttatgccatacttatgctgaggccctgggtagggaaagtataaaaattagaagacctgtttcactaaaatctctgtaagatgccgagaacataaggcaacgcttctgtaaccaagtaatagtgcaaagcataaatctacctgtggtgcctccgtttcctcaccccccattattcttcagaatactccaatcttcttgaggtgatcagccaatttatccctaataatagaaatga

SEQ ID NO: 336878 - DNA, 1023 bp, Homo sapiens
ttttttttcttctcttaaccagattaaaactaacattaaaaaaaacaacaggtggtactagaggtgtgggtagatatcaggaaatgcttccctcaggaattgatgtgcatgaggaatcctggagaataagaaggcatgaagtagagatgaaagagaatgtttcacacaaaggaaacatatgcaagcatcaactcaactctatgcctacagttctggggcagaagaactgccaagggagaaattatgcattgcctgcccccagttccctcaggatacattacattaaggaagaaatcattctcaaaatgtggaagccaaagcaaactcccattcttgactagaatattcagcttgccatttaccattccattctgagaggcaaaagttctttctctcagtcccttttccccagaaactgtgagaaggtgcagagttgttggatgaagaagcccgttcatcaagggctcctccctgtttcctgtgctctttctcaacccaaactcagtgtgcctccttggccttagcagtttccttcactcctggactgatgggtggcacatgattgtgcacttaaataccacagtacaaacgggaggaacacctggctaataactcacagccccaatttctcattcagtaccttagcccatgtaacccagactagctagagcagtgaaggtcctctctcatccttgattacatgcatcatttattacatcctaaacagagatgattacattccaatttcaactgtccttaaaacatttctttaggctcacagaaacatcagcagcagcttttcctcagctaattagagactaattgactctttagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 336879 - DNA, 1034 bp, Homo sapiens
  misc_feature (42)..(43): n is a, c, g, or t
  misc_feature (60)..(60): n is a, c, g, or t
gcagtacttcatgcgctacacgcttttatacaaagcagggcnnggcctagtgggtaatangagtggtactagaggtgtgggtagatatcaggaaatgcttccctcaggaattgatgtgcatgaggaatcctggagaataagaaggcatgaagtagagatgaaagagaatgtttcacacaaaggaaacatatgcaagcatcaactcaactctatgcctacagttctggggcagaagaactgccaagggagaaattatgcattgcctgcccccagttccctcaggatacattacattaaggaagaaatcattctcaaaatgtggaagccaaagcaaactcccattcttgactagaatattcagcttgccatttaccattccattctgagaggcaaaagttctttctctcagtcccttttccccagaaactgtgagaaggtgcagagttgttggatgaagaagcccgttcatcaagggctcctccctgtttcctgtgctctttctcaacccaaactcagtgtgcctccttggccttagcagtttccttcactcctggactgatgggtggcacatgattgtgcacttaaataccacagtacaaacgggaggaacacctggctaataactcacagccccaatttctcattcagtaccttagcccatgtaacccagactagctagagcagtgaaggtcctctctcatccttgattacatgcatcatttattacatcctaaacagagatgattacattccaatttcaactgtccttaaaacatttctttaggctcacagaaacatcagcagcagcttttcctcagctaattagagactaattgactctttagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 336880 - DNA, 1034 bp, Homo sapiens
tgatgaatagtaaataatatttaagatgtgaggggcaagcagtcaaactaaggggaactagagtggtactagaggtgtgggtagatatcaggaaatgcttccctcaggaattgatgtgcatgaggaatcctggagaataagaaggcatgaagtagagatgaaagagaatgtttcacacaaaggaaacatatgcaagcatcaactcaactctatgcctacagttctggggcagaagaactgccaagggagaaattatgcattgcctgcccccagttccctcaggatacattacattaaggaagaaatcattctcaaaatgtggaagccaaagcaaactcccattcttgactagaatattcagcttgccatttaccattccattctgagaggcaaaagttctttctctcagtcccttttccccagaaactgtgagaaggtgcagagttgttggatgaagaagcccgttcatcaagggctcctccctgtttcctgtgctctttctcaacccaaactcagtgtgcctccttggccttagcagtttccttcactcctggactgatgggtggcacatgattgtgcacttaaataccacagtacaaacgggaggaacacctggctaataactcacagccccaatttctcattcagtaccttagcccatgtaacccagactagctagagcagtgaaggtcctctctcatccttgattacatgcatcatttattacatcctaaacagagatgattacattccaatttcaactgtccttaaaacatttctttaggctcacagaaacatcagcagcagcttttcctcagctaattagagactaattgactctttagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 336881 - DNA, 1039 bp, Homo sapiens
attatcagatgctctaaccaaactgaaaagacaagaaaataattttagtggaactagcagtgtggttgtggtactagaggtgtgggtagatatcaggaaatgcttccctcaggaattgatgtgcatgaggaatcctggagaataagaaggcatgaagtagagatgaaagagaatgtttcacacaaaggaaacatatgcaagcatcaactcaactctatgcctacagttctggggcagaagaactgccaagggagaaattatgcattgcctgcccccagttccctcaggatacattacattaaggaagaaatcattctcaaaatgtggaagccaaagcaaactcccattcttgactagaatattcagcttgccatttaccattccattctgagaggcaaaagttctttctctcagtcccttttccccagaaactgtgagaaggtgcagagttgttggatgaagaagcccgttcatcaagggctcctccctgtttcctgtgctctttctcaacccaaactcagtgtgcctccttggccttagcagtttccttcactcctggactgatgggtggcacatgattgtgcacttaaataccacagtacaaacgggaggaacacctggctaataactcacagccccaatttctcattcagtaccttagcccatgtaacccagactagctagagcagtgaaggtcctctctcatccttgattacatgcatcatttattacatcctaaacagagatgattacattccaatttcaactgtccttaaaacatttctttaggctcacagaaacatcagcagcagcttttcctcagctaattagagactaattgactctttagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 336882 - DNA, 724 bp, Homo sapiens
attatcagatgctctaaccaaactgaaaagacaagaaaataattttagtggaactagcagtgtggttgtggtactagaggtgtgggtagatatcaggaaatgcttccctcaggaattgatgtgcatgaggaatcctggagaataagaaggcatgaagtagagatgaaagagaatgtttcctgtgctctttctcaacccaaactcagtgtgcctccttggccttagcagtttccttcactcctggactgatgggtggcacatgattgtgcacttaaataccacagtacaaacgggaggaacacctggctaataactcacagccccaatttctcattcagtaccttagcccatgtaacccagactagctagagcagtgaaggtcctctctcatccttgattacatgcatcatttattacatcctaaacagagatgattacattccaatttcaactgtccttaaaacatttctttaggctcacagaaacatcagcagcagcttttcctcagctaattagagactaattgactctttagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 336883 - DNA, 338 bp, Homo sapiens
attatcagatgctctaaccaaactgaaaagacaagaaaataattttagtggaactagcagtgtggttgtggtactagaggtgtgggtagatatcaggaaatgcttccctcaggaattgatgtgcatgaggaatcctggagaataagaagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 336884 - DNA, 578 bp, Homo sapiens
tggaggagtacagggacctgtagaacgtggtctggggcttctgggagccttattgacttagtcaaagctcattggctatagagtagggggatatacaaaatggaaagagcaagataatttgttttaaggtgtttttatttgccctagttttaacaaaactttcttagacttattaggcattttgtaccatttacttgactattactgtgatacattacatgaccactgcctttagtgttaatctttgcaaagatctttttgtttctacaattgtaatgcaagccttcttataaaatattcaaacaatatagaaacaaaatgagaaggtggtatgtgtggggtagggagaccattgctaggagattttcttcattatgtgctttttttgttttttactgtaaaaattgtgggagacttttaagtagcctacatattaaagcattttgagatgtgtgatagagcactgcttctctgaaattcttaaaaattctgaagtttaggctgggtgtggtggctcatgcctgtaatcccagcactttgggaggccgaggtgggcggatcacaaggtcaggagatcg

SEQ ID NO: 336885 - DNA, 1104 bp, Homo sapiens
ataaagtgtgcattctagaaacttagtaaaaatattacatatgcacaaaatacataaaagaattgcacaatgaatccaaataatgatggagccagtattgggaataagataattgccttactttttatactttcacaacctgggtatgcatccccatcagtatattttatttttgcacattttttatgcaaatgataaccaatgtgtgatattttatattggattttaactcagttatgaaccttacatggaatgatagttaattcactttcttatttcattgattttattatttagaacagtggttgtttgcccaaaacgttgagcaaataatccacagagttcccacatttttcttccaagctcataattccccctgttttaaacatcttgactggccagatgctgtgcctcatacctgtaatcctaccacttagggaggctgaagcaagaggacagcttgaactgcagtgttggagttcagcctaggcaacataacaagaccctgtttcaaaaaaaaaaaaaatcattttaaaccatattgactgtgtgtagtatatcccacaattgatgcaagaatatattacatgtgaacacgatggaaattgaagaaaccaatattattattacctaaagtccatcttttacattaaacttcactctttttgttctgtggtttaagacaactacatgtgtcttgtatccaccatcacagtcttatacagaaacgtttcactgccttcaaaatcccctgtgctcctcctaattctatctctcccctccctcttttgccacccctatttatccctggcaacagatgatgatgttccttcctctagagttttgcattttccagaatatcacatatttggaatgatgctgtaagtggccatttcagacttgcttctttcatgtaaaaatatgccttgaaggtctctcgatacctttgttgcttgacgactcatttattttttatttttatttatctaaaaaaattttgttttgtgagagacagggtctcaaactcctcagctcaggtgattctcccacctcagcttcccagagtgctgggattcctcttgtgagccaccacgttcggccact

SEQ ID NO: 336886 - DNA, 249 bp, Homo sapiens
ctggtccaaatgagaggtagctgtagttgagaacagaatatgccaatgtcggctggacgtggtggctcatgcctgtaatcccagcacttttgggaggcttaaactcccttgagcccaggagtttgagaccagcctggccaacatggtgaaaccccatctctactaaaaatacaaaaatacaaaaattagctgggtgtgatggcatgtgcctgtaatctcagctacttgagaggccgaggcagggagaat

SEQ ID NO: 336887 - DNA, 274 bp, Homo sapiens
tggtagacggaggagaagtccatccccaccacccaccagaaggcgacggtctccttctcccgcccctcatcctcgacggctgcagcatcctcccgacaggcgccaacaaccccataatcgtgctgcctcacccacgagttttgtaaaaagcacaggtagctcacgtttgcttccctggacttaaacatccctcagttggctttcctctctgataatgagagccagggtcccaatccgaagtcagcttgccgggcgtaccgagactctgaattcg

SEQ ID NO: 336888 - DNA, 397 bp, Homo sapiens
aaaaaatattcctatgagaatacaggctgaaaaagatcaaagtaaaatgaatcaggtcggtatcagaaatttcagtgatatacaatgaaggaataaaatggagcagcagctatagttttgaaacaaaatgtattttccaaggttcttgtacccaaccaaattataacttatgtgttaggacaatagagaagtaattttagccaaagaaataatctgaaattatagcatctatgcacatttattgaaacaagaaactcagaaatcaaaatagccgagaaattaataaaatattcaaaaggaggaaaatacattttagaataaagcataatgaggaataaaatcactatgactttttgaaagtataaaaattgttatttttttctatgaatacttgctc

SEQ ID NO: 336889 - DNA, 368 bp, Homo sapiens
ccatccataatcccattacttagtgaaacagttgtaaatgttttgggcctgtcttcagttgacttttcaggataaattcacaagctgctgttctttcccgtcctctttttattttaaagtaatactagaaattctaatgataactttatgttgtttggttcttccttcatagagtaagataaaaagactgataatcagaacagccatggtttataaagtaaatcataaagaaatttactgatttaacaaagatcacagaatgagtgtgtaagcaggtttgagattagtaactaaatcttcaaatatccaaattggacttttggttatttcgtgtcatgtattctgacacagctaaggttatttagtgt

SEQ ID NO: 336890 - DNA, 471 bp, Homo sapiens
cctgattcttgccttttctgaccatctcagtcagaatcacttaaaccatcttctgagtttccatagctgtttatagcacacgtagcaataccatgcagtgactgagtacagccctcagtccacacccctgcttcctagctgtgtgactgacaagtagattaacctctctgtttccaaatctataattaggaataataataacagttcctactttatagagttgatgtgtgaggattaagatgttctgtggtacatagtaaacatccaaatgttacatgctgttattggtggtgacggcctgattactattcataaatcgctagaggctaattactggctgcctctagtttcagctcttcctgtgtctgactgcttattgctgaatccagggttgcccagttttgtaaggggtatatcctaacctgcaggttaccctcagacacttgttggaatatttttgcgaataacatt

SEQ ID NO: 336891 - DNA, 167 bp, Homo sapiens
atggtgaatttagcatttctttttatttcattgtgttttgcatctacttctgttgcttagtcctttaagcagtgatcctaccaagctgattgaaaactgtatatttaaagaggcatctaactgtggacttgagatagccttgcctttgagcagcatgtactttctcc

SEQ ID NO: 336892 - DNA, 394 bp, Homo sapiens
tgtggcacatccagacaatgaaatattattcagcattaaacagaaatgagctatcaaaacataaaaagacatggaagaaacttaaatggatattactaagtgaaagaggcaaatctgaaaaggctacatactgtatgattccaactgtatgacgttctgcaaagacgtatctgtgaagactataaaaagaccagtggttgcccacggcatatctcttaacctccctttgtctcagtttccaatctgtatgatcacgatcaatacaacctacttcttagggttgaggtgagaatgaaataatattttatatgtataaaaggcttcgcacatagtaaccttcagtaaatattagctctattagtataaacaaaaggtaccaagtatgatatctcaa

SEQ ID NO: 336893 - DNA, 431 bp, Homo sapiens
ctctctatagggaatttgggccccccaggccaagacttcggcccgaggagtctacccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336894 - DNA, 1922 bp, Homo sapiens
taactagaaaaagaaatttgtaaaccataaattaagatgcacaggtggaggtatactgtcatcaattaaggcagagatatttcaacttctaggatcataaatccctatgggtctgatgaaaagccttgcaccctctgtcctccaaaaatacaccctgcactaagaactcttagaagttacaagctggccacccatgggcaacacccagcacacagactggtttggtttagacactgaactgtcttaaaattttgtttgcttttgttaaaaagttgagaattttcataaaaatccagatttccaacatctcttgaacaatcgggaaatccgataacaacttgggcccgcattctcacatggctgaagttacctggcgtggaatagaagctgcttcccatgatgggcatgcactgtccagtttgccgtagtttctaccacttcctcttctctgtcctgcttgccttagtttgtcatttggctgtgggcatttaagtttgcagcccccatcttagacgtaaataagctacagaaaaggaacaagctgacaaagttcctatcttggctcctgtaagaccagctctccaagccgtaccaaagaaattcctcttttggttttgcatgttctatccttacataatccagtcctgggggaggggcaagggacataccaagtagacaggtgcaggaagctggcaggggtccagctctggtccagggtgggggcatggggcagaacatcctgttctgccagtctctgggcttttcctaatcagggattaaagtctccagtgacaggatagaagaggtccatggaccctgggtctccaaccctcttggttttgctcccatcctcttagggtggctgagtctgtgaatccatgctggggagggagctcagacacctgaccccaaatgaaaaactgagcctacagctctcaccactgggggtggaggggcagcagattcattgtacagaggggtagcatgttatcatcacacttccccttctgtgtctctcccagtgggggcgtgatgctggtacatgacatccgacgaaatgagagccacctaattgatttccgggagtccgcaccaggggccctcagggaagagaccctgcaaagatcctgggagaccaaggtggggaccctggtgagaagagagagttcaggggagtctctcttcattgcccttctgctaacccaagcattaatttgctaagtatttaccaggggagtgggaaaaagagttgagcaggattctcttaggctatgagagagtcaggcagcccccaagataaaataatgaactagaaaatctggaaccttacttctctgggaatcttacctatctggcacgtgggaaggaagaaaaaaggctactgagtaccctgaaatgtcacgaagttgatgcaatgaaactcacacatctcactctgagccagttgactataactttcccagcccttgatatattggaagattagaggggaattgccagaagtaaaccaactgtctgctgaaagaaaaagaagatatcgaataacttggaaaaatgggtacttagtgcggtggcaaaagccaaacacacccctgagtcttcagagctcagagtaatggtggggtgaaactgaataggttaaatgaaggtcctttgtccaccgttttaaaaggtagggttgcctgggcacagtggctcacacctgtaatcccaacactctgggaagccaaggcaggaggattgcttgaggccaggagtttgagaccagcctgagtgacatagtgagactttgtctctacaaaaaatgctttgaaattagccaggcacagtagcatgcaccaaggatcgcttgacttgagcccaggagttggaggccacagtgagctatgactatgccactgtactccagcctgggtaacagg

SEQ ID NO: 336895 - DNA, 5370 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336896 - DNA, 5355 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336897 - DNA, 3488 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336898 - DNA, 5463 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagccatccctggcttggggctctgcggagttcagcccagcaccccccttccagtgacctggtctcctctctccctcgcctacccgccttgcccagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336899 - DNA, 3733 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggtaggatttgcttccctgctttcctggggaccctgaggcctataggtaggaggtgcaatggcatggctgcccctttctccctactttctccagaatcttctagtataaggaagcctaaagaagaggttcacctcatccctagccctgctaagtctgggacatggagcctggtgggtctgaagaacccttgtcccattctgtcactgtcttactgtgtgaccttgtgaagatcttg

SEQ ID NO: 336900 - DNA, 3519 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcacccccgacttccagcaggaccggggggaccatttggaccagctgggccagcagctccaacggggcctgtgggaccaaccccgaaggtcatccgggtcggagctc

SEQ ID NO: 336901 - DNA, 2350 bp, Homo sapiens
  misc_feature (6)..(6): n is a, c, g, or t
atcggntaaccgttcgtacgagaatcgctgtcctctccttgctcgagatccattgtgctctaaaggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336902 - DNA, 2173 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacacacacacacacacacacacacacaca

SEQ ID NO: 336903 - DNA, 1904 bp, Homo sapiens
ggcaatgtggacatgggctgcgctgagtttcttagtgaaaatggagccctgatgctccctgtctttcccggttgcaggggaaatggcagggtcagtagattgaaaagtggggttagcatctgggtggcctgggttctgttaacctcaagtcccattatacctctacccagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336904 - DNA, 1487 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaaggtggggaccctggtgagaagagagagttcaggggagtctctcttcattgcccttctgctaacccaagcattaatttgctaagtatttaccaggggagtgggaaaaagagttgagcaggattctcttaggctatgagagagtcaggcagcccccaagataaaataatgaactagaaaatctggaaccttacttctctgggaatcttacctatctggcacgtgggaaggaagaaaaaaggctactgagtaccctgaaatgtcacgaagttgatgcaatgaaactcacacatctcactctgagccagttgactataactttcccagcccttgatatattggaagattagaggggaattgccagaagtaaaccaactgtctgctgaaagaaaaagaagatatcgaataacttggaaaaatgggtacttagtgcggtggcaaaagccaaacacacccctgagtcttcagagctcagagtaatggtggggtgaaactgaataggttaaatgaaggtcctttgtccaccgttttaaaaggtagggttgcctgggcacagtggctcacacctgtaatcccaacactctgggaagccaaggcaggaggattgcttgaggccaggagtttgagaccagcctgagtgacatagtgagactttgtctctacaaaaaatgctttgaaattagccaggcacagtagcatgcaccaaggatcgcttgacttgagcccaggagttggaggccacagtgagctatgactatgccactgtactccagcctgggtaacagg

SEQ ID NO: 336905 - DNA, 324 bp, Homo sapiens
gcggccgcctacacccggacctgcagtccaacctcctgcaggtggacagtgagtgcagagcagagacctcgtggggcgggcacagggacaggtagagaaaggactcctcccaagggtgcccatgcctcaaccagcaccaactgccagtgaagtttggttttatttggcaaatttctattggagcagtgaacgatctggggattggaaccagtcttgccatttcctggttgtgtggccttgggaaatccatgtctcaactctgagcctcagttttctcatttgtaaaataagacacagttgttcattcttcaaactttcatttac

SEQ ID NO: 336906 - DNA, 4516 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336907 - DNA, 4652 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtgcaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336908 - DNA, 5062 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttcaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336909 - DNA, 5298 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336910 - DNA, 4650 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336911 - DNA, 4582 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagggctgttaggaggctcagatgacacccggtgtaagaattctcaagactaaggagcctggaccaaggcaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336912 - DNA, 5412 bp, Homo sapiens
tcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagtgacctggtctcctctctccctcgcctacccgccttgcccagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336913 - DNA, 5805 bp, Homo sapiens
taactagaaaaagaaatttgtaaaccataaattaagatgcacaggtggaggtatactgtcatcaattaaggcagagatatttcaacttctaggatcataaatccctatgggtctgatgaaaagccttgcaccctctgtcctccaaaaatacaccctgcactaagaactcttagaagttacaagctggccacccatgggcaacacccagcacacagactggtttggtttagacactgaactgtcttaaaattttgtttgcttttgttaaaaagttgagaattttcataaaaatccagatttccaacatctcttgaacaatcgggaaatccgataacaacttgggcccgcattctcacatggctgaagttacctggcgtggaatagaagctgcttcccatgatgggcatgcactgtccagtttgccgtagtttctaccacttcctcttctctgtcctgcttgccttagtttgtcatttggctgtgggcatttaagtttgcagcccccatcttagacgtaaataagctacagaaaaggaacaagctgacaaagttcctatcttggctcctgtaagaccagctctccaagccgtaccaaagaaattcctcttttggttttgcatgttctatccttacataatccagtcctgggggaggggcaagggacataccaagtagacaggtgcaggaagctggcaggggtccagctctggtccagggtgggggcatggggcagaacatcctgttctgccagtctctgggcttttcctaatcagggattaaagtctccagtgacaggatagaagaggtccatggaccctgggtctccaaccctcttggttttgctcccatcctcttagggtggctgagtctgtgaatccatgctggggagggagctcagacacctgaccccaaatgaaaaactgagcctacagctctcaccactgggggtggaggggcagcagattcattgtacagaggggtagcatgttatcatcacacttccccttctgtgtctctcccagtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgcacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336914 - DNA, 3882 bp, Homo sapiens
ttgtgttctggcttaaacaaaaggattccatacaaccattgacattggagttaagtatgcagaaaaacaaacaagacgttttgatgaaggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataaccccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttcaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336915 - DNA, 2449 bp, Homo sapiens
taagcatcccctcatggcccctgatctggggcatccctggggtccccctgagaccaaacctgggagaaggagggactctgggaacatgcaaagtgggggactaagaaccaggtggcctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336916 - DNA, 997 bp, Homo sapiens
cgatgcccgtatatcagggcagaggggatccttagcaaacccaatcccagagtaactggaacctacctcgctctgggggccaatggagctgcgcggggcctcagcggcctgacacagcaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaacatg

SEQ ID NO: 336917 - DNA, 186 bp, Homo sapiens
ggacaaggtgtttgggttctgataccactagcaaagcttgattgctctgtgtagtcactgcagtcagactggtgtgtatttcctcatcaaagaggaactctgatgctttacaccgtaatttgtataattaatcttctgagtttttttgaaattgcatttttgttgttgttgctgttgttaataaat

SEQ ID NO: 336918 - DNA, 230 bp, Homo sapiens
tctggggggagatgaaaaaccaactcgtccttgttcctgcccagagaagcccagatttttaacttcctggtgtcttaaaagcagtccccattcttcagtctctcttctctctggttaggtaggtgatctacttagaagaatagtgtattcataactctcccctcgcccacccaaccaactcagtaaagcagttttcaaaacgaggcgggatggtggctgggaaggggtgc

SEQ ID NO: 336919 - DNA, 153 bp, Homo sapiens
ttctgtttagttctgaattgctcttggggaagagaagggcccagtttttgcttagggttttgcagaagagctttgctgactcagttatctgtgtatcatgatgactaagtttcagggtagcattttgctatctttgcagaaggaaaaattaca

SEQ ID NO: 336920 - DNA, 128 bp, Homo sapiens
ttctgtgattaaaatgccatgaaggactccagaaaacacatgatatttagtgacttctcagcacatgcaaagttccgtgctaggcaccgtgtttcaggctgccagtagtttttttttttttttttttt

SEQ ID NO: 336921 - DNA, 251 bp, Homo sapiens
gctctgcccaccggcccctcctggcctttccccatcccgcacacacctcagctccaggacactcttcccgggaggaactctgctcacaaagcccaaggaccagacagaacggcccttcctcccctcacccacctgaaccaccccagaaagccctgagcagaggccaggccacccagccctctgccatgtatgaaccacctggtcccacaccttccgggtgtcccaggccccctcacctcacacctcaacac

SEQ ID NO: 336922 - DNA, 485 bp, Homo sapiens
tgttgataaggtcaacagtagtgtgcagtcatgtcctaggccttcacattcgctcaccactcattcactgacccacccagagaaacttcctgccattcaggctccattcacaggaagacccttatacaggtgtactctttttctcatttatgccatatttttactgttttgtttttaatggaaacataattgcacatatttatggagcacaggatgatattttgatacatatacacaatgtgtgatgaacaaatcaaggtaattagtatacccatcatctcaaacaattgccatttctttgtggttaggacattcacattcctcttttcaagctattttgaagctgacaatacattgttgttgactacagttgccctactctgcgtcaggatgtcagaacttatttttcctctctatctggaactttttactggttgactaatatctcctcatcctccatttcctcattctttccagctctggta

SEQ ID NO: 336923 - DNA, 722 bp, Homo sapiens
atctcaccattgcgctccagcctgggcaacaagagtgaaactctgtctcaaaagaaaaaaaaagaaaagaaaagaagaagaagaaggttcatcttcagactcctagtccagagctctcagcaatcctcatcttgtaatgctgtctacagactccaagatctcccaacgtgaattagcaaccgatgcatcaaaggtggcacctcggccgggcacggtggctcacgcctgtaatctcagcactttgggaggccgaggtgttggagcgggccggagagaagtagagtgggctgcgaggagaaggaaacaggcctttcggaggctcctcatccctcggaggtcatcccttactccaggtgatctgaacctgaagtccgaggccccaagagttctaagtaacccaggggtggaggtggggtgggggatcccagctctttccgatctgggagatcagaaagatgctcatctgggagagtgggacctcccctttcagtccgcccacccccgaggaccgcacttggagggccgcacttggaggaccgcgcctccaaggcgggcgcggctgacgcccggggcccaggccatgtggggcgtgcgtgccgggagaagtgtcccagcgcctcaccccgcaagcatgagaacccgggaggcagacgttgcggcgagtcgagatctcaccattgcgctccagcctgggcaacaagagtgaaactctgtctcaaaag

SEQ ID NO: 336924 - DNA, 1116 bp, Homo sapiens
agcgggggggcgtctccgagcggcgggccgagggagggcgcagcagctgctccctgaacactttctgacccagcagtcccccagcgccggacgcgccgcgccctggcggctctagggaccccccccgcgcctgcacttagccccgcgcccgagtccacagacaaacgaatttaaaggagcaaccgaggaggcacctgcgaaagaaagcccacacacaggtgaatttaaaggagcagccctggtgtcacctatcagtaaaagaatgttagaacgactttccaagtttgaagttggagatgctgaaaatgttgcttcatatgattgtataaccattcaccagcttgtgtcaatgctggagaggaagtacggccatagaggaagttaactcaccatggttgtaagctgttggtgtctaaacaaagattggaaacaaagagggcaaatacaagtagttcttcaaattaccctgaatttgccactgaattaaactgtgtgtctgcagattagctatacgttttctgtaatggagctgcccagggctgaaacaaaattagattaagcaaggcaagcatttccttctttcctgactccaaacaaaataaagcaggttttcattttattttatttttaaattacaaagtctcattacgtagatataggaggaatttgcagtagtccctgtgagaaatgctggtgtttcataccagggggatgatactggatttatagtaaaagctggaatcagtgcttggctttggcatatcatatattcattcacctgatactcagcaagtcactaaccctctttaactttcagattattcaaatgtaaactggctataatgcaatctatgtactggatattgtattgtaaaaaattagtaataaaacgaaaataacatgcaaaaatacttcgaaaactctgtagatctgtaaataggttttattctaaaaactgaaaataacgtaagaggtcattaaaggaaaatcagaaaatacaatcaacaaatctacccacatatagtcattcttaagctttgatgcatgcacttctaagttcttcaagcatatactttttttgtttacagatatgagaccatacttattcttttgtaa

SEQ ID NO: 336925 - DNA, 703 bp, Homo sapiens
agcgggggggcgtctccgagcggcgggccgagggagggcgcagcagctgctccctgaacactttctgacccagcagtcccccagcgccggacgcgccgcgccctggcggctctagggaccccccccgcgcctgcacttagccccgcgcccgagtccacagacaaacgaatttaaaggagcaaccgaggaggcacctgcgaaagaaagcccacacacaggtgaatttaaaggagcagccctggtgtcacctatcagtaaaagactatttggagttttcctcgtcttactggatgtcactctcgtccttgccgacctaattttcactgacagcaaactttatattcctttggagtatcgttctatttctctagccattgccttattttttctcatggatgttcttcttcgagtatttgtagaagggtaagtttgattatttttataataagaaccactttgggaggctgaggtgggaggatcccaaggtcaggagttcgagacaatcctggccaacatggtgaaaccccgtctctactaaaaatacaaaaattggctgggtgtggtggtggttgcctgtaatcccagctgcttgggaggctgaggcaggagaatcatttgaacctgggaggcagaagttgcattgagccgagatcatgccattgcactctagcctgggtgacagggtgagactccgtctcaaaag

SEQ ID NO: 336926 - DNA, 708 bp, Homo sapiens
tataaaaggccatgataatatcttctgaagtggtttggtgagaattttgtttattaagaactgcttctattgggtgaaaacagtgatttttctgagattctaaggcattacagtttttcctgccactgggcagcttaatactaaataataacattttggtacctgatcagtggcttaaatatagtatagctatagggacaaatgcccctttatctttgcatttatttatttatttatttatttatttatttatttatttattttagactatttggagttttcctcgtcttactggatgtcactctcgtccttgccgacctaattttcactgacagcaaactttatattcctttggagtatcgttctatttctctagccattgccttattttttctcatggatgttcttcttcgagtatttgtagaagggtaagtttgattatttttataataagaaccactttgggaggctgaggtgggaggatcccaaggtcaggagttcgagacaatcctggccaacatggtgaaaccccgtctctactaaaaatacaaaaattggctgggtgtggtggtggttgcctgtaatcccagctgcttgggaggctgaggcaggagaatcatttgaacctgggaggcagaagttgcattgagccgagatcatgccattgcactctagcctgggtgacagggtgagactccgtctcaaaag

SEQ ID NO: 336927 - DNA, 676 bp, Homo sapiens
agcgggggggcgtctccgagcggcgggccgagggagggcgcagcagctgctccctgaacactttctgacccagcagtcccccagcgccggacgcgccgcgccctggcggctctagggaccccccccgcgcctgcacttagccccgcgcccgagtccacagacaaacgaatttaaaggagcaaccgaggaggcacctgcgaaagaaagcccacacacaggtgaatttaaaggagcagccctggtgtcacctatcagtaaaagactatttggagttttcctcgtcttactggatgtcactctcgtccttgccgacctaattttcactgacagcaaactttatattcctttggagtatcgttctatttctctagccattgccttattttttctcatggatgttcttcttcgagtatttgtagaagggttggagtgcaacggcgcgatctcagctcactgcaacctctgcctcccaggttcaagcgattctcatgcctcagcctcctaaatagctaggattacatgtgtgtgccaccacgcccagctcatttttgtatttttagtacagatggggtttcactatgttgaccaggctggtctcgaaatcctgacctcaagtgatccgcccgccttggcctcccaaagtgctgggattacaggcgcgagccactgtgcctgg

SEQ ID NO: 336928 - DNA, 716 bp, Homo sapiens
ccactggatctggggccatgttggggggccagtgaagggggcaccccaggctagtcttccaggagctccctggttggggggacaaggaaggacacaggcagggacaaccagggccacactcagggccattgtgagggacagggatggggctgttgccatcgtagtgacagagctgtggtatgctcctgccaccttgcattccagcccaggctgctcccatctttggcagagggtgggaaaacacatgatcctgccttccagagactgtactggtcagagaaagacatcagcaggagagccagagattcctcctcctctccatcatcaccatcaccattattctcatcaccatcaccgtcaccgtcatcatcatcatcaccatcatggacttcaaagaagttcaaagaatttcctcctctggccagagtgaatcctgttctgtggaagcaggaggctgggtgggaagccctgtggaggctccacccgtgtttgggttctgggcagggatctggggacagggtaggcctaatgcttattgcagaaattctctgcctgggaagtcaggatcactccttggaggaggcagcctgtcctctgagctttcaggaaaggaactggttgtgtggttccctgtaagctctggagatggggcgggcagtaggggggagcacagcagtgtggatgtattaatacttagtgctggccgggtgcggtgg

SEQ ID NO: 336929 - DNA, 988 bp, Homo sapiens
agcgggggggcgtctccgagcggcgggccgagggagggcgcagcagctgctccctgaacactttctgacccagcagtcccccagcgccggacgcgccgcgccctggcggctctagggaccccccccgcgcctgcacttagccccgcgcccgagtccacagacaaacgaatttaaaggagcaaccgaggaggcacctgcgaaagaaagcccacacacaggtgaatttaaaggagcagccctggtgtcacctatcagtaaaagactatttggagttttcctcgtcttactggatgtcactctcgtccttgccgacctaattttcactgacagcaaactttatattcctttggagtatcgttctatttctctagccattgccttattttttctcatggatgttcttcttcgagtatttgtagaagggtcaacgccaccgcctctgcactgccttcctggccatcatcccaggtagagctgccctcttccttctccgcagcttttctcatcctgcaaagcaagggtgttggagcgggccggagagaagtagagtgggctgcgaggagaaggaaacaggcctttcggaggctcctcatccctcggaggtcatcccttactccaggtgatctgaacctgaagtccgaggccccaagagttctaagtaacccaggggtggaggtggggtgggggatcccagctctttccgatctgggagatcagaaagatgctcatctgggagagtgggacctcccctttcagtccgcccacccccgaggaccgcacttggagggccgcacttggaggaccgcgcctccaaggcgggcgcggctgacgcccggggcccaggccatgtggggcgtgcgtgccgggagaagtgtcccagcgcctcaccccgcaagcatgagaacccgggaggcagacgttgcggcgagtcgagatctcaccattgcgctccagcctgggcaacaagagtgaaactctgtctcaaaag

SEQ ID NO: 336930 - DNA, 878 bp, Homo sapiens
agcgggggggcgtctccgagcggcgggccgagggagggcgcagcagctgctccctgaacactttctgacccagcagtcccccagcgccggacgcgccgcgccctggcggctctagggaccccccccgcgcctgcacttagccccgcgcccgagtccacagacaaacgaatttaaaggagcaaccgaggaggcacctgcgaaagaaagcccacacacaggtgaatttaaaggagcagccctggtgtcacctatcagtaaaagactatttggagttttcctcgtcttactggatgtcactctcgtccttgccgacctaattttcactgacagcaaactttatattcctttggagtatcgttctatttctctagccattgccttattttttctcatggatgttcttcttcgagtatttgtagaaggagactgtactggtcagagaaagacatcagcaggagagccagagattcctcctcctctccatcatcaccatcaccattattctcatcaccatcaccgtcaccgtcatcatcatcatcaccatcatggacttcaaagaagttcaaagaatttcctcctctggccagagtgaatcctgttctgtggaagcaggaggctgggtgggaagccctgtggaggctccacccgtgtttgggttctgggcagggatctggggacagggtaggcctaatgcttattgcagaaattctctgcctgggaagtcaggatcactccttggaggaggcagcctgtcctctgagctttcaggaaaggaactggttgtgtggttccctgtaagctctggagatggggcgggcagtaggggggagcacagcagtgtggatgtattaatacttagtgctggccgggtgcggtgg

SEQ ID NO: 336931 - DNA, 121 bp, Homo sapiens
tgctgtgatcataggcatgagccaccatgcctggccttccacatgaaatttaaagtcagcttctcaatttctattgttttggttctaaaatagatgtaagggttttaaagtgagcaacaat

SEQ ID NO: 336932 - DNA, 616 bp, Homo sapiens
tctctcccactccgcatctaatcctcactaaaactggttcttaccttcaaaatgtattcagaatgtgaccatttctcaccacctccaccgtccccatcctagattgctgcgacagtctcctaattggtgccctgcttccctgctgctactcttggagtcactctacctccacccatagtctattctgaacagaggaggaaatctggtgcaatatgaatcagattgtgtcatttctttccttaaatcccttaaaagccttcccagcaaggatgatgccaaaaggacgaatgtgcctaaagcagactcgcgggcctcggggcaggctgggggcaggagagtctccaagccagtgtctccctctccccaacctatttctccactggcagtcctgactgtatcacctatcttctgatttctcaaaaaaggaagctctttaaagggagggaaatgcaatcaatcagcttccttttccagctggataccacaagaagccaacaacactaacacttctgaagaagcaataaggtacatcgagtctgccaacacttaatagtgtttccaaagatgaggctagccctccagagactcattctttatgcccttggtggcagtgggg

SEQ ID NO: 336933 - DNA, 266 bp, Homo sapiens
atctgtatttattaggtaggcaaagaggaacaatgaagtattttgaagttgctggaatacactatctgatccaagtgctaggaagacaactctgttgtgatattccaggtggcgggtaatgtgggtttaggtggagcagtggctatggtggctagaacttctggagccctagaaattagtcaaattatttacatgctgttgggataagggaaaagttaaagatgttcctggatagatagtgctgtcattcataaggtagggaactc

SEQ ID NO: 336934 - DNA, 91 bp, Homo sapiens
tcttacaaagaattatttaaatcagaaattcgtgtctagatgtagtggcttgtgcctgtaatcccagcatactgggaggccaaggtgagag

SEQ ID NO: 336935 - DNA, 433 bp, Homo sapiens
tgttaaggatgcttataaagatcatggctttatgggctacagggaccttgagagctctttgcatctttcttttgcccaccagttaggatggctcctgaggttctcaaactgaggaaggggtgggcagacatatcttccaggctgctagtcagatacatacacttctcttcctactgaaggcctatcttattctctgaagatgttaaatttcacaatttgcctccataatttctttttatatttctcaaccttgaggcaaaattgccaatgttgataatcttagagatggaatcctgacaccaaaagatctttggagtataaaacaaaacaacctcccattttcctgtgcgttatgatgctggggacagtctttgttaatcccccccgccctgcttttttttttttttttttttttttagacagggtctggctg

SEQ ID NO: 336936 - DNA, 185 bp, Homo sapiens
tttgacttaaattataatatttcatatcaaatagcaagtcttaacgagacaatgactacaattccatttgatttcagtggactttgaagatggatcacctctctcattcagatgaaattctttggagagaattttatttccaaagtaaggattttcatcaaaataaaaatctattcagcaatttg

SEQ ID NO: 336937 - DNA, 408 bp, Homo sapiens
tttgacttaaattataatatttcatatcaaatagcaagtcttaacgagacaatgactacaattccatttgatttcagtggactttgaagatggatcacctctctcattcagatgaaattctttggagagaattttatttccaaagtaaggattttcatcaaaataaaaatctattcagcaatttgatttaatgtcatcaaattccatcacttcgactctggtcaagtaatgcactgcctcttcgtcctcctccccaagcagtgcagacacttttggatggttaacaaatgttgttacccaaaaatctgggattttggcaatcaattctgacctcttctgagaaaattatttacggagtttgttatatttctgttctactttcaaaatctcctcactggcttgttcatt

SEQ ID NO: 336938 - DNA, 6256 bp, Homo sapiens
  misc_feature (1642)..(1642): n is a, c, g, or t
gcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgnaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttaaaaaaaaaaa

SEQ ID NO: 336939 - DNA, 562 bp, Homo sapiens
tagcatagtttgaggggttacgctgctccgtcagatcattgtttttgtcatttgtattctctccttccttgttgccagagtctgctgtaggatggtaaggaacagtaaagggttggggtgaagtagtaagaaaaaaacaattagcatttctcttctggaatgaaaagtactgttggtgtacccgactaaatatggatgtttatctgtatcattatatatttgataaattaaaatttattctaacctgaatttcataattggatctaagttattttgtcatatttattaccaggaagaattaacacaaatttgctaatttatgattctgttcttatagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtaagtacaagttgctgatgatggtcatgttgaactaacagacttctcttaacttcatagtgcattca

SEQ ID NO: 336940 - DNA, 745 bp, Homo sapiens
gtgaaggaattactttcaagtattccattatcactgaccatgcattccagcctgggcgacagagcgagactccatctcaaaaaaaaaaaaaaaaggaaaggaaggtttaagtgcctagtccattctagtattgcagttacaaacatttataatgacttaatgaacgtgtgaataaattgtaaattctttgtatgaaataaattttcagttttaaaagactatgttacaatatcctaagatactacataataagcaaatatgtttaagtatttgttttgttttttgggggatttacagggtcatcatcaaatccacagcaaatttccagttttgacttcacaaccacaaaggctttatcagaagactcagtagtagttgttggaaaaggtatttcaaagttatttcgcttcttaattatatgtattcatcatatagaagcaaagcctatcaataaggaatagaaaagaatgtgattcaagtgttgagtggaacttctttttaaaaatgtattacattatcttcattaaaataattagaagtgaatacttaccttcacatttctatcttctaatgaaactatagtaaattcatgtcattaattttcagagagatgtattatgtgacagctgcagtttaggtacttctaagactattttaggatagcttacttagttttagcatagtttaaattcaagtagcccttatttatcagcgtaataatcaatataaattaatataattatct

SEQ ID NO: 336941 - DNA, 4334 bp, Homo sapiens
tagcatagtttgaggggttacgctgctccgtcagatcattgtttttgtcatttgtattctctccttccttgttgccagagtctgctgtaggatggtaaggaacagtaaagggttggggtgaagtagtaagaaaaaaacaattagcatttctcttctggaatgaaaagtactgttggtgtacccgactaaatatggatgtttatctgtatcattatatatttgataaattaaaatttattctaacctgaatttcataattggatctaagttattttgtcatatttattaccaggaagaattaacacaaatttgctaatttatgattctgttcttatagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttaaaaaaaaaaa

SEQ ID NO: 336942 - DNA, 5950 bp, Homo sapiens
  misc_feature (1642)..(1642): n is a, c, g, or t
gcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgnaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaaggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttaaaaaaaaaaa

SEQ ID NO: 336943 - DNA, 6023 bp, Homo sapiens
  misc_feature (1642)..(1642): n is a, c, g, or t
gcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgnaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagaggtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttaaaaaaaaaaa

SEQ ID NO: 336944 - DNA, 4186 bp, Homo sapiens
tgggtaatgcgtatactacaaatactgggaagaaagcaagccaggtctggagaaacgttccatgctgagagaaagagtgtaggaagaaactgcttttgcagatattcttcaacatacctgtcttttccctgttctttactagtctgtcttctgtcctttaattcctgccactaatctgattttctagtatcaaaagctgtatccctttcttgcctgcctacctcactgtacttaaacacttatatttatttccacctaaattacaccaacatttatgaaataaaatgtattcatgaaataaagttaacttttgcttttatgttttctcccttcctttcttcaaaaggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttaaaaaaaaaaa

SEQ ID NO: 336945 - DNA, 6169 bp, Homo sapiens
  misc_feature (1642)..(1642): n is a, c, g, or t
gcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgnaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttaaaaaaaaaaa

SEQ ID NO: 336946 - DNA, 400 bp, Homo sapiens
gtaaggttatttgctaattattagaataaatttaagcttacagtatgtcattgttttgtgtatatcagatgtggggtggtgaaagtatttcaattaaaatttaaaaaatcttagtacagttgaaattttgagccttggcaatgtggcaaagccctgtctctaggaaaaatacaaaaattagccaggaaaaatacaaaaattagcccgagaaagtagagagcctattttctctaggaaaaatacaaaaatgtagctacagccatgcgtgcctatgggcccagctacttgggaggctgaggtaggaggatcacttgagctcggacggtcggacttgagctgcagtaaaccgtgattacgccactgtactccagcctgggcaatacagtgaaactgtctcaag

SEQ ID NO: 336947 - DNA, 104 bp, Homo sapiens
atgtaactcctgcacgtgcagttgtttctcttatcaatggtggacaaaggtaatgttcaaaataaccttgaaatgtctttaaacaaaaaatgaaatgttgcaat

SEQ ID NO: 336948 - DNA, 401 bp, Homo sapiens
caaaaagaaagagcctgatgatatttggaagtgtgaaaaagatagtcttccaattgatctttcagaattaaatttcaaggataaagatttggatcaagaagaggttagaaccaaatatttttaatgacttaaaaatatttgcaattttctataatatagttgctatttaaggaaaaatcaagttctttttatcctataatatcttatttctaaaaatatgttcattatagaaaatgtggaaaataccatgaattagtaggaagggaatttatcacgccagttcccactaccagaataatttactgttaacactctactgtattttcttcaagtattttttctatgcatacattattcctttttaaattaaaagtatgaataataatatagcaatacactca

SEQ ID NO: 336949 - DNA, 218 bp, Homo sapiens
gcattttatgcattttggaaaatgaatgcataatgagatttttaaattatgtttgtataatagtttttataggaaagtacaaatgaaattaccttcacctttctttcactttagagctgtaactgaagttcgtgaagtcaccagaaaatcagtccctcgtaattccttagaaagtgctgagtaccttaaactcataactggcttattaaatgcaaaag

SEQ ID NO: 336950 - DNA, 469 bp, Homo sapiens
caagaccagcttgaccaacatgatgaaaccctgtctctactaaaaatacaaaaattagctgggcattgtggtgcgcacctgtagtccccagctacttgcgaggttgaggcaggagaattgcttgaagcagggaagtggaggttgcagtgagctaagatcgtactactgcaccctagcctgggcaacacagcgagactccatctcaaaaagataaaaattttttttaaaaaggttctctcatagtttatttaatgtattttgttttaggtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattggtaagttcaccatccttaacttaaaactaagcagagttcaaaagcttt

SEQ ID NO: 336951 - DNA, 255 bp, Homo sapiens
tgaaggttctagtcaggaaaattaagcaagaaaaagaaataaaaggcacacagatcagaaaggaagaggtaaaactatatgcacagatgacatgatattgtatacagaaataataaaaaatccacaaaagctatcagagctaataagcacattcagcaaggttgcagagtacaagattcatatacaaaaatcaattgtatttctatactccagcaataaacattcaaaaagaaagttagcataataattccattg

SEQ ID NO: 336952 - DNA, 395 bp, Homo sapiens
atcaaaagcatatttctgactggtaataattcctatcctcaaccaacaaaataggcagtaagtaaagatacctcataaccaggtggctttaaaatataaaccaaaaatcactctaactagctggataaattggtattctatttgaacttttaacagaatctcaatctaaatatcagagcaaggattcacctttagcaaggattcaactttaaatgaaaatgttttggggtgttgagaattcaaacttctcagaattgtaaggttctatcatggcaatgagtggtgaaaagaagtatgaggaggaagaaaataaatatgtaatttagagtttgttcagaatccaagagttaactcccctcattcaagaaagttgagtcatgggcaaaccacaggtg

SEQ ID NO: 336953 - DNA, 550 bp, Homo sapiens
tgtgtgtgggaaacctgagatgttggtacatgactgagcttgactcagctccaaagtgagaccacacactgccagctaggtggcagttgtaggtgagtgaaagggtgtttaggtgcccatctgggactgtgtccatcttccacaatggtcaagggcacagactagggccagactccccggagttacattgcagccttgccacttactagctgtgtgtccttgctttaattgcttaacattcctgtgccccagtttcttatagagcagggaaaattatggtgtctgcctaatggggttattttgaagaacaactgaattactatttctagagtatgtataacaatgcctgggcaagctataagtaagcagtaagggtttatggtagtggtgacgggtgaaggggagagaggactagaactctttggatataggagagagaaggagaggctgcctagagcacgaagcccagttcagcctgacgggacacagggcttgggttgggaggcgggtgttgcctccagctctttcactcaccaagctgggtcatcct

SEQ ID NO: 336954 - DNA, 304 bp, Homo sapiens
aaagctattatcacgttatatttgtaatatatctattctatactggaaagttttctttatagcatttttattttacattttgttgcatgaaagttaaaaaatttaaatctgctcaattaatcacccctgcttccggtaacaacctttgttttctgcagtgattagaaatgcatgttctccaggttgggcaacatagtgagactgtgtctccacaaacaattaaaaaattagcaaggcatggtgacgcatgcctgtagtcacagctacttgggaggatgagatgggaggattgcttgaccccggg

SEQ ID NO: 336955 - DNA, 433 bp, Homo sapiens
ctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatggcacaaccactatcctccttccttcactaagttctagccaagctggtctatttcatcagttccttgcagagaccatgctttaagtgcactcagatactttgcacatgctgttccttctgcctggactgctcttcccactactttttttttttttttttttttttt

SEQ ID NO: 336956 - DNA, 343 bp, Homo sapiens
ctcctttggtagcagctggtttggctttgttgtcattacacagaaagtctgcatttgttagttgtgaaaataaataatggcccgtacatatgcagagattcaaaaggaatataaagacaggccaagcagttgcctgagagaaagccaatataatattgcaggtctctccttttgtcacctcttttccgtcagtattttctggtggtcacttcagatcaaatctctttcctgagtttcctgaatgtccacctgcccctgtccatcaagacttgactctctcacactcgtcaagatggatgtgccccagacagaactgacgactgtcttctttcctcgccagtct

SEQ ID NO: 336957 - DNA, 344 bp, Homo sapiens
gtagccaccacaaactcctcccaagccagagtctggcagaggtcctgctattccagagacctggaggaaggcatctatttacagccatgtaggcaggcctgcataccttggcctttaccatggtccctgaaacagttcactgactcagtttccgttacacgagccacagttcatggtcagtcctgcctatatagaaacccacacagttacctgaggaaatgctctctggtactcactgaaagccacactcatccacatcctgatttaaggcccagcatctgcagacctgactgcaaaaacatgccctagtgtctgccctacagagcaaagtcccgaaggatatg

SEQ ID NO: 336958 - DNA, 440 bp, Homo sapiens
cagactgatcagttatgattcaaaatagtcaagccagaaagggcaagcgacctcagtaatgcaataatgatggagagatgaaagagtgatatttagagaataaatataatgacgagtaagaggagagcgtgaaatggagggagaggaagagacagttccaaggattctggtctggatgactgcattcatagtgggaaatatacagagaataactagtagaaaatcatagttcacagtttaggcatattgaattgaaagtgtctttagcgcttcttggtgaaattatggaatgaatagatcaccagaaagcaagaatcaaattagtaaaaaagcccctgtggatagcccccaaaaatttctaaagcaaatggtaggcaagaaagaggcggcagcaaaaaagaacaggatgatgaatccaaagaaaggaaatggagcaacgc

SEQ ID NO: 336959 - DNA, 1305 bp, Homo sapiens
gcaaaacggacactttgaagtgaccttccctgtttaactcatccgctcctcccttcagtgagtacatactactgtgtgcggtgtgctcttccagatgctgggatgcagtagtgaatggagacaaagcccctgtcctcatgggcttagactccagcttatgacttgttgtttataataaataatgaacattgtgaggttattcacaggaagggatgaataatggatggatcttcaaaacgtgattctggttaactacagacatcctgaagttccaggtataaaaagccttctttaaagcatactatagcagtcagaatgaatgagtagttaataaagctctttgctgaaataaaagcaaatatgttcacacttccaaaaaataaatacccaagtgggagttgtatggttctgatgtcaaacatgttatgagaccatcagaggtatatggaaatttggggaggaagacagtaattatataaaagtgcatgcaagcctgggcaatatagggagaccctgtcagcctgcaaaaaaataatgataataaaaaatcgtagctgaaggtggtggcatatacctgtgggtcccagctgcttgggaggctaaggtagaatcactaaggagaatcacttggggcagggaagtggtggctgcagtgagctatgattgtgctattgcactccagcctgggcgacagaacgagaccttgtctcacgcacacgaaaagcaattactgaattagagatgtgatgtgggaaacgctcccatctaagtaatgaccaagaatattccgtgatagagatgaagtcttagcaggacttccctctcaggttattagtggtgatgatcctgctttgttttattaccttattactattatgctctctgaggtatgaagtgatattaatctgtttgcagtgagaaataacactttatagcattgctatcatttaaacatattaaaatatgttgtaatgcagaaaaacaccctggggagagaggtgaaaacttaggagtttaatttgaaatgcagttgggaaattatttggacagcagagaaagctttagggcaaaatttcagtaataaagtatattattttctaaattattcatcagggagttgagtttgtttttcatgtacctggacttaatcacgattacaaaaaaatgcttagctaattgtagtcattcatctatactaatccaaaaacaaaaatgaggagttattgatggtttttatttaggtaaaacaatttatttgactgtgagtggttacatatgataaccatatattcagttatttctaac

SEQ ID NO: 336960 - DNA, 425 bp, Homo sapiens
ctcctgctcccttcttcagagctcccagccaccagcgggactcctcgggggctgcccctgacctcttgcctgctctcctgagcggggccacctgctgcctccccaccttctgaccggccatttcctccctccccgggcagctcctccatcacgaacggcagctggtctccacttagctgcgcctcctctccccgaggctgggcctccaggtcctcgtagttgctttgctttctggtatggaggttggttaggggaaccaggtatatgaagaaggattatttgatagaaaacgaggagttacccagtccttgagaaggaaggtgcatgtacgtacctatgtgcatacacttattttatatgttagaaatgacgtgttttaatgagaggcctccccgttttattctttgaggagtggggaagggaaa

SEQ ID NO: 336961 - DNA, 406 bp, Homo sapiens
ggaaaatttaataaaagaattattaacaaaaagtagatactgctaagagagcgttctgtgttttctgagattctgtattcatctatttggcatccattagtctaatcacagggtcaaactcacgcacagccaaagctgtttccgtctcccctgccacccagagcccattctctgaaccacctccttatctaactctcacacacagagccaatatttctcctaccctaaatcacccagagctaggaaccagacaacgagggacggccctctgccccagggccccccagaattatccaaaatagccaatcctcagatgtttccctggccctgtctggcctttcccacagaagcccaacaaaggctctggcctgggcgttcccccagctcctttctgccctgtggatgg

SEQ ID NO: 336962 - DNA, 116 bp, Homo sapiens
acacaaaaaaatttgattcaaaactcagaggtttagctgggcatggtggtataggcctgtaattgtagccagctgggaggctggagcaggagggtctcaggagtgtaggagttcga

SEQ ID NO: 336963 - DNA, 266 bp, Homo sapiens
cttagatggagtaattcatggccaagcaatgctgcaggtgtggtcagcacatgtagttgataggcagactcctattattttaaacaaacaaaccaaaaaagttttttaaaaaatgagacccaccttcatcttgaatatgtcaaccccgcaccaccgttgtattaatctgtcatgtttttctcatataacaaaagaatggattttctttcttttaatctaaacattgtatatacaagtatagtgtttaggtcgacgcggccgcgaat

SEQ ID NO: 336964 - DNA, 397 bp, Homo sapiens
cttagatggagtaattcatggccaagcaatgctgcaggtgtggtcagcacatgtagttgataggcagactcctattattttaaacaaacaaaccaaaaaagttttttaaaaaatgagacccaccttcatcttgaatatgtcaaccccgcaccaccgttgtattaatctgtcatgtttttctcatataacaaaagaatggattttctttcttttaatctaaacactatacttgtatatacaatgtttatttatataggacctaagcaaaagtttttatagatgtgttcatgtcatcacaattcaggtaatgtgaaggctcaacttccgtcttctctctttgtaaatctcactgaagcattagatctcaagtaaatacatttgtaaaatatccatgtca

SEQ ID NO: 336965 - DNA, 401 bp, Homo sapiens
tacatcagggtacagaggccgagtgtgggtacatctggggtacagaggccgagtgtgggtacatctggggtacagaggccgagtgcgggtgcacctggggtgaggggctgctggggggctggagagcagacacacctgcaatgcagaaatgaagggagaggcccttccattccctggtgcttactgaacaggcgccaggtggactagcagatgtctgaaaggaaagactctccaggaaacaagtatttgtggaaactcaaaagagccgtcaatgagtgccaccttcacctcctctcctccctctctcccccttgaatccacaccgacaactccatcagccacatgggccggggcagagagggcaggtgtgctaggaacagacatcgcagccacgctgcccg

SEQ ID NO: 336966 - DNA, 429 bp, Homo sapiens
ctgctggggggctggagagcagacacacctgcaatgcagaaatgaagggagaggcccttccattccctggtgcttactgaacaggcgccaggtggactagcagatgtctgaaaggaaagactctccaggaaacaagtatttgtggaaactcaaaagagccgtcaatgagtgccaccttcacctcctctcctccctctctcccccttgaatccacaccgacaactccatcagccacatgggccggggcagagagggcaggtgtgctaggaacagacatcgcagccacgctgcccgggctcaaacccccacctccgagatccagagccagggacctaactgcaccctgcctccatttcccccatctgtaggatggggataatcgtagtgcctgctggctgggcacagtggctcacacctgtaatcccagca

SEQ ID NO: 336967 - DNA, 640 bp, Homo sapiens
tcttgtatattagttattttttacacttttaagaacagcatctttgaatcttttcaagtacagtatgccttaaatgtataggaccactgagttcaggaagaaaagcataggtattctgtaggtgaattacactaacaaaatcacaactgcagaatgtgatctgatacttttgttggacagtaaagctaatacattttatatacacagtcataccttttttttttgtaatgtgtttcgttaacgtaagcacacagtcatcacagactgagacaggactttgttagaccagatcttgtgagctaaatatttaagagcttaacatatataaatgattttaattggtattgggcgaaggaaacctaaaaatgcttaaattgacagatcttacaatttgcttactgaaaattcagaaagcttttatgaaaactttgtattttaaaatattttttgctcattctgaattagaagttagatcccttttaaagagggtctcactctatacaaatatagcctatgaagaatcaatagtgaaataatagtgtttatattgaaccccaggatgggacattattttttgaccatttacatgaggtctttctctaattaccaaagttaaccttaagagtagttaaagactcag

SEQ ID NO: 336968 - DNA, 291 bp, Homo sapiens
actacctttctctgaggatgaggtacaatttcctagtgctaagattatttacattgcaacctgaattaatctgagggaagatgacattacaaagttccatacccatctggcaaagtatttggatagctgaattttaagccatgggaaatacaaagaatcacacaaaacaaggactaacacaagcatttaggaatgacatggtgcctctatgtatgtaagcttcttcaccattttaaatgtccatgacaggccaggtgcagtcactcatgccaataatcccagcactttggg

SEQ ID NO: 336969 - DNA, 1389 bp, Homo sapiens
atcattctattttcaaagaggtcttggcgttttcctacatcttttgtttagagggggaaaaaagtttcatttgctgccatttcagaaaggttatgctatcctgttttatccaagcagttgtgagtcaggaactgcctgggcagtgtgcatcaactttgtggccgaaccattacagctgtcatatccttggctgatcgtctctcccagggactactgccctccacttagtgtctgagggtaagcctagaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaggtgcattccttaaaaaaaaaa

SEQ ID NO: 336970 - DNA, 349 bp, Homo sapiens
tatgtaaaaccaagtataaactgacttggagcaaaatttaggtaacccccaatgtgcagtattaaataagttttgttatcctactaattattttcagatggaatttcagcaatgacaaaaaaaattacatgtttttgtttgttttgagacagggtctcttgccctggcgggagtacagtggcacaatctgggctcactgcagcctcgacctcccgggctcaagcaatcctcctacctcagcctcccaagcagctaggactagaggcctgcaccaccacacccaactagtttttttcatttttagtagagacaggattctgccatattgcccaggctggtcttgagctcc

SEQ ID NO: 336971 - DNA, 189 bp, Homo sapiens
gtggcaggggactgatgggggtgacgggtgggattggggacccagagttagccagtctttcatctgttcatttgttcattcattaattcaaagtattgagcacctagtgtgtgccaagcatcgggacacagcagtgacccaaacggacaaagtccttgtgcttgtggagctgacattggagggggcagg

SEQ ID NO: 336972 - DNA, 511 bp, Homo sapiens
tgttccaggcatgcaacatgggtagcagagctcagccctctcaagaaaatcctccctttgcatcctatttttaggtttggtaattgcaccaatgttgaataaagttgtcatcgttatgacagttttgttctcctacataagagatgaatgcagccagcaaaatgctttgacaacaattaattgcactcacgctgtgtcgttacacagatccatttccataaccctttctcttcctggacttgggctgttctgttttcatctgtgctctggcaaatgactgtttgggcagagccttctccaggcctcggagctgccggtccaagctggacatcttggggctgcctctgttcctgaggctcaggcagaaggcactactcactgtgggcgtttgagggggcatcctgggacatgccctgtgatttggctcatcccaggcaaaggagaggaggagctgaccaagggagtaagccttcaggacacaaccacacattctagggaaaggtgggggcaa

SEQ ID NO: 336973 - DNA, 430 bp, Homo sapiens
cactgggggtgaacaagagaggctggacaaaagaacgcactacccctcagtgttttgaaataaaagagattctattatttggtggtgcaaaaggagatattttcccattaatatcttgattcatcaggttgagaagtgataaggataattcccattttatagatttcccatctataaaatcccttcaaacctcagggaggatgaagacacgtggaatcatctattgtgttggacgtaatatgcatctcatcaacagagtattgtctttggaagataaatgtccatcatctgacggtaatacaaatcaatgggcttctactgacatcatcaagccactaacaaacaggaagtgtaagaaaagccagtgtctctggttctcatgattctggagagaaaggtaaagtgattcgtgcacgtgaattctctccat

SEQ ID NO: 336974 - DNA, 275 bp, Homo sapiens
tagatatgggggtctcagtatgttgcccaggctggtctcaaactcctgccctcaagcaatcctcccaccttggcctccctagtagctgggactacaggctcaaaccattgtgcccagcaccctagtcattttaacatggagatgtaaattatcaaagtccaaagttggttaatattgttaccttcatcccaagaattacaaaaacctagaatattttaacttggatcctttatctaattcttaattgttttagttatattctatttcacaaaaag

SEQ ID NO: 336975 - DNA, 425 bp, Homo sapiens
ctttttgagcaccccctcacatgttgtcctgaagccagtgcctcgtttgcccctgctagtatcccagccctgatgacacagctcttgttgaggccctggtgacctcctggttgccacatccaaaaacttggaagtcctctttcatctgactgctcaactccagctgacactgctaattcatccctccttgaaactcttctcccttggctgagctcacaccactatattctacacagacccttctctaactttcttctactcctcagcatactctttctgcacctgtcccttaaatgctggtgcctaccatccgtctctcatccaaactcattcccctagccattctgttccccctgctttagacctcaccctctccaaatctaccttccatctaagtgaaatttctaaagttcatgcctgaactg

SEQ ID NO: 336976 - DNA, 242 bp, Homo sapiens
actttcctcccatttaacactatatcatgaacatattcctatgaaaatgagtttttttgtgaattgtctatttatgaatttttcgtttttttctattgacttttttaaaattaaaatttgtagttactctattagctccagtctttgactttacaagcccttacacatacatctcgtatcagaaagagaaaaaagaaaaatcttactgcctttccttacttgctagtaggaaaacatactca

SEQ ID NO: 336977 - DNA, 253 bp, Homo sapiens
ttttcaactcacccagggtcaccaagatgccaagtggcagggccagggctgcccccaggctgctgtggatcaaagcaggacactttccacatctctgacccttttgagtcaaagtgcccagggtggggccttgcctccctccttcccctggcctgaggccagcgccatccccagggtgaaccaagtcagtcccacagagcagaatcccaggcagaaggagcctccagctgcagctcttctcccggactcacct

SEQ ID NO: 336978 - DNA, 359 bp, Homo sapiens
ttctacctatcagaaaattggctatggctcacgtaagaataagaatcaggaaaaaaatcatttgcctaatttttccatctctgagtgtataccagcagggatgaatggcacacatattcggctgtgtctgctcttctactttcctggggcctctgtagctctaagttcaaatattaataatgagggaagcttgcagcatgcctgtagcaccagactagaaatcagatcttgtgtgacattaagacattatgcttctttgcaagtataacctttagtgaattttgaatgcttggcatatttgtttgagacataatggcttcttaatttttaaactataataaagaccatttatgagggct

SEQ ID NO: 336979 - DNA, 397 bp, Homo sapiens
aagctgggaataagaaacagttttattttcaagcctagcaattgcaggcttctttatgtttcctctaaattttacatgagagcagaaccattctttattaaggtcctctctctcctctcacatttttttcatagacagcaagaagaagccagatggcactttcagtattctgtctagaaatctccttatctagatcatcacatttgttacgtacattttctattttctgccttcccataggcaacagtgttgtcaaattttctccttaacaaaggtccgctttcctctggctcgaagtagtcttttccctgttttcctcaggccctcactgacctcctcttgaaggcctgccatgattcccccaacagtctctcagaacctttccagcttccaccta

SEQ ID NO: 336980 - DNA, 135 bp, Homo sapiens
ccaggtctcgaagccagacatggggctggtggccctggaggctgaaggccaggagctcctgcttgagctggagaagaaccacaggctgctggccccaggatacatagaaacccactacggcccagatgggcagcc

SEQ ID NO: 336981 - DNA, 254 bp, Homo sapiens
  misc_feature (15)..(15): n is a, c, g, or t
  misc_feature (62)..(62): n is a, c, g, or t
agttcgacggagacntctcttttaaactttatttaattaattttgagacagagtctctgctntgtgcccaggctggagtggaatggcacaatcatagctcactgcagcttcaaaatcctcaggctcacatgatcttttcctccctcttcccatctgaataatccacctgctttcagaacttcaactgccacctcaatgttgacgactctcagaggtctacatgtcctctccagacatctctaagcctgagacct

SEQ ID NO: 336982 - DNA, 543 bp, Homo sapiens
ttttaatagtttaagtgcatgatgtctacgactgattttcaaatagttccaaaaaatacacacatacaggaaaagcaagcacaatcttgtctgtgagaaagactaggtgaaggcaaaaaactgtacccagaggatacgagccacctaagaatacacaaaatgcacacacctcagacatctaccagcgactttagtttatgggagttttatgatccacactcctctacaactggtgctactataagttctcatccaatttcagatagctcccccagctaacacatcacagtaactcacaagctgcaactctttgcaacacactcctataagcaaagctgagtttttttccaaggtaagatgccaaattgattgtagtattcacatatttattcaccacttaacatgcataaactgggcacagtgtctcacgcctataaactcagctacttgggaggctgaggcagaggatagcttgagcccgttagttcaagggtgcagtcagctatgatcacaccacctcacactagcctgaagaacaaagca

SEQ ID NO: 336983 - DNA, 185 bp, Homo sapiens
tatgcaagtattacgtgaatacactcctctctttgagtcacacttgtagataaagctgaagtctcttggacatgacttcaacctccccagatagaaccagttagtactgtgtcatttacgctttcaaatcttcctctgcctgtaggaatatcgtgttttgaacatgttgtttggcctaaatagca

SEQ ID NO: 336984 - DNA, 1150 bp, Homo sapiens
agtaatcacttattctattaaagtttgtatattatgaaattcatctacctaaagttttccccttgagtctgagcctaattataattgattttccgtactctaccagagattagaatgaaaaatctattaatacaatcatccttagagtgcaacaaattgagccatttaccctagccccaaacttgggaagccctttgcagttgttacagaaaccagaaaagtagtcttgcaaagaatcagaacaagggcaaaaagttaaatcagtatcagcacatataccttcccttaatgcctttttattatgtataaaacagtgtgggttatctctcttccgacttccaatgtcctccctatcaaccactaaacattaatgcttatttttgccagataaaatataaaagggggccgggcatggtggctcaggcctgtaatcccagcactgtgggaggccgaggcaagtggatcattttgagatcaggagtttgagaccagcctgggcaacatggcaaaaccccatctctaccaaaaattacaaaaattagcaggacatggtggcgcacacctgtagtcccagctactcaggaggctgaggctggagaattgcttgaaccagggaggcaaggctgcagggagccaagatcatgccactgcactctagcccaggcaacagagtgagaccctgtctcacaaaaattaatcaattaaattaaacatagaaggggttgaataaaactataagaagtagagatattggctgggtgtggtggctcacgcctataaacccagcactttgggaggcaaggcgggtgaatcacctgaggtcgggagttcaagaccagcctgacaaacatggagaaaccccgcctctactaaaaatacaaaaattagcggtgtgtggtggcgggcgcctgtaatcccagctactcgggagcctgaggcaggagaatcgtttgaacccggaagatggaggttgcagtgagccgagatcatgccattgcactctagcctgggcaacaagagcaaaactccggctcaaaaataaaaaagaaaagaagtagagataagatttaggtatgggcttaatacacaacttataaaagaacattcattcattcaacaagtatttactctatacctaccaaggttggaa

SEQ ID NO: 336985 - DNA, 264 bp, Homo sapiens
aaaaatgttaaatttatagaaaagtttaataaatagtttaatgaactcctatatatgcctcaccttgattccccagttttaaacattttaccacctttgctttctctctctctgtctctctctctcttatgctctcttttccccactgggattattttattgaaataatttgggaataagttgcagatatcatgcttttttatccctaattgcttgagtgtaagcaagaacatctcctgcatgaccacagtacaataaccaatt

SEQ ID NO: 336986 - DNA, 265 bp, Homo sapiens
acaggtaaaaggagaccagaaggaggtgggagatggctgaaagacacactatgagtaagcccaagactaaattcacaaaatcttgtttcctcacttttgtattctaaatgtctatcatagtatgaacatctcactgctctgagtgtaattcttgtatataataatacttatttttaatgtaaattggaccacaaaatgccaactacttcatttggtgctctactgaaaaatgtaagttctttttttgttgttgttgttttctact

SEQ ID NO: 336987 - DNA, 449 bp, Homo sapiens
gcccacagaataccccctagtccccttgccttgtggtcctgccccccttggagtattgacaccatagcccgcaaaaaggaggaagtaaaacccactgggtcacagatccctgaacaccccacccccaggggagggtggcagtgggagatttgattcctcctctacagcagccctttaaattggagagctcatggttcagatcacacctctgccactttcttgctgagtgatgctgagcatggggctttacttctgagccctgctggcctcatctataaaccagtattagccatattggcagggcgcagtggcttatgcctataatcccagcactttgggaggcgcaaggcgggagatcacctgaggtcaggagttcgagaccagcctggccaacatggtgaaacctcgtctctaccaaaaatacaaaaattagcctggcatggtggcag

SEQ ID NO: 336988 - DNA, 593 bp, Homo sapiens
gcccacagaataccccctagtccccttgccttgtggtcctgccccccttggagtattgacaccatagcccgcaaaaaggaggaagtaaaacccactgggtcacagatccctgaacaccccacccccaggggagggtggcagtgggagatttgattcctcctctacagcagccctttaaattggagagctcatggttcagatcacacctctgccactttcttgctgagtgatgctgagcatggggctttacttctgagccctgctggcctcatctataaaccagtattagccatattggcagggcgcagtggcttatgcctataatcccagcactttgggaggcgcaaggcgggaggatggcttgagctcaggagtttgagaccagttggggcaaacaaggtgtgaccccatctctacaaaaacttaaaaaattggctaggcggctggcacggtggctcatgcctgtaatcccaatactttgggaggccaagatgggtggatcacctgaggtcaggagttcgagaccagcctggccaacatggtgaaacctcgtctctaccaaaaatacaaaaattagcctggcatggtggcag

SEQ ID NO: 336989 - DNA, 970 bp, Homo sapiens
gcatggatacatatgcattctagggttagcatcaaaggctggagggagtcaggaggcaaaacatatgctgaaccgataagggatctagagctgtttatcccaaagaaaagaaaatgaggccacataaatatcttctaatatttggggtacttttatatgaacatgggagaaggcatttgtgtttctcaaggcagcagaacagaattgaatatataaattcatagaatttttaagctgggcaagaccttaggagctcattcggcccaaggagtacatataacttttcatctgtatgccagctccaaccaattggcatgttaagaaggattctgaggatgaatctaagctcagaggggaggggaaaatgtggtcactgatagtgatatctgttgtggaagagaagggccatatctactcaagtaccatgttttagtcttcattaatgtggtctgtaggtttttaacctctgggtggtggatccctgggaggccacaaagtcattgcaagaggtaaacaaatctgtatatgcagcaagtgcttttggcaagctactctgagtaaataatatatcttacatcatatgtgctactatttttctaattctatacatacattataatgataaaatgctaatttatttaaaagagttattgaattcatagtagcttttaagtttgtgtttttgtgttttattaatgagtggacttaaaacatataattatattatgtgtgggaaggttgggacaggaaatttgggatcttaagtagaaattctttttaaaatatgaaccagtgatctattttttattctccaaagcctagccacaccaagtaaaattatgtatgtatttgtaggtttcttcgattaatgtctgccctgtcttattggtctgtcagatatataaggacaggaacctctatttttttttcattcgtatatacccagtgcgtggcacacggcagaatctca

SEQ ID NO: 336990 - DNA, 401 bp, Homo sapiens
tgagtgtttcacagccggcatctcagcttctgctcgcaggagccgcctagttttggcagatgagggctctgaggcccagagaagttaaagaatttgccaatgaagtagcagagcaggacttgaatccacacttgcctgactccaaagccaggagcttcttgggaaaggccaagagaggacagggcctggcggtcccctccccaacacgcacacccctagtgtgttttgaaagatggcaggctccctctttgccatcatccgaggacaaagggcgggcagtttctccagaagcgagtctgagtcttgtcctgatggttccggcccacactccctcgtatcctagcagcatgaaccctccacctcactcaggcacaggactcctcccaggaggggggattcga

SEQ ID NO: 336991 - DNA, 397 bp, Homo sapiens
cgtggtggtgcatgcctgtaatcctagctacaggggaggctgaggcaggagaattgcttgaacccgggagatggaggttgcagtaagccaagattgcaccactacactccaacatggagtgtagagacagaatgagacttcatctcaaaaaaaaaaagtatagtcaaggaatatggtgttatgaatatttgctgagggcatcatgtgactatcgtttaaaatacagtcatgtatacgtacaatagaattagatagtttctgtgccagaattcttatttattgtgagatatatcaaatttttacttggtgattcagaatttaaactatatcactacctgtacagtttattcaaaaaataaatatttaagttataaatttattagttatttataactta

SEQ ID NO: 336992 - DNA, 268 bp, Homo sapiens
agccttaaaccactttgtgatttaaggagcatccagatgtttagacataaaacactattgctgtgattaattgaatggtttttctgaatactcaagttttacacatacatgggggtagggagaaggcctgttattataccttcactattcaacctccattgtacaaaattcatgatcattttaaaaacatacattagaactgcatttaagagttcacccttctctccattatcaacaagtaagtcacatttctagattacttcccact

SEQ ID NO: 336993 - DNA, 455 bp, Homo sapiens
aactctcagaacccgaatgtgtaaggaaatcctctctggaacttacccaagtgttctcattcccttttaatcctcagttctctttttctttcatttggactaagaatgtactattattcaaaagcctgcttcatccataaaacattatggagggaaacactgtatttttacacatgacaaccaatagaaattcttgtactactcctgagtatttcaccagtgtgtaatagtcactgctaatgtgtatttcctatagagcacacaacccacatcaccaaagccaacgtagacaggatacaggaaaagagacaacaggtactcacttcagtgaataaagagaacaaagaactacaaatatacccaattttcttatttttgaaatatcagaaacttttactcacaacacctaccacaactctctaagaccaaggctatcttataattgacagacttgg

SEQ ID NO: 336994 - DNA, 427 bp, Homo sapiens
cttttccttttaaggtaatgggcccatgtgttgcttgattactgggaatgaaaagtcatactttatgaacagggattaagcttttttaattttcaggtttttgggtggaggggaagagtatgttttttcaaagtctgtgtaacttgaattaaaactctggatattttcagatgtagccagcaattgtcttctttcttaaatgctaacagtgcattaaattataggcctagaagccagaattattgcttttttctctttttttgtagaaggtatactccaacatatgtgagttttttttactttgttttttaatttgagctgacgacaaaagaaagatcctgtaagttaggggataaaataaagatcctataatttgggcctggcttaaaccataaaaaattgattttttaggggagagaagtaatat

SEQ ID NO: 336995 - DNA, 153 bp, Homo sapiens
aaatgtttataacaatctaacacgcatatatacctttgccaatgtatccttaagaatcatgtcagtaactcctatgtacccagtgttttccctgtggaattgttttctcctccctactctttcttcctcttcttccccttatctctatgtata

SEQ ID NO: 336996 - DNA, 3600 bp, Homo sapiens
actcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgccccccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 336997 - DNA, 734 bp, Homo sapiens
cggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaaggttggtttattctgcattctcttggacggggcctggggacaccgtggcgcttctatgggatggcaagtgttgacagggtgctcttcctctcctaccccaggatcaggttcattccccattgttgtcagaaaggtcagttgtctggggtacaaatattaaactgccctttacgatattgccttctgaaggaagtgttcaaatctttgcttatgccaagtgctgttttgtacctggaaggtttcacagagctagtgagactgtcatatatgcagaattccaccctcttgtttcacacagcattcctctcccatcccagtccaggttctctgtaacatcacattctctggtgactttttagacagcttgtttggatccgtcttcagaaaatagccacattgaatagtaaatggaagttggttaggatggattgctaaatatagatcatagcttacctcataaagaacaagatgagcttgataagagagtaatgaggcattaagattcaaagctgaggtttcagctagagaattcaggaagccgcatgagatagaccacacttgattttaagagccagccacat

SEQ ID NO: 336998 - DNA, 2562 bp, Homo sapiens
cggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 336999 - DNA, 2132 bp, Homo sapiens
cgcgattagaggatcccgcagctctctctgatgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337000 - DNA, 2283 bp, Homo sapiens
tcccataacattattaatagggaatcttttctgcatgtggttgtgtcaggttgtcaaacatcagatggttgtagatgtgtggtgtgtttctgaggcctttcttctgttccgtgggtctatatatctgttttggtaccagtaccatactgttttcgttactgtagccttgtagcatagtttgaagtcacatagtgtgatgcctttagcttggttcttctggcccaggatggtcttggcaatacgggttctttttgggttccatatgaagtttaaagtagttttttccaattctatgaagaaagttagtggtagcgtgttgggcgataacatcagtgatgtaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337001 - DNA, 1924 bp, Homo sapiens
ggtaccaatgcagcggactcgggaggaaacagagaagagtctcggtcatggttccatcaggctcctgagcaacttaaaacagtctgctccaaaaacggagcagagtcattggtaaatgtgagtgtgaagaaagggtgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337002 - DNA, 1019 bp, Homo sapiens
cttttgggtctttgctcttttggggtctttgctagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337003 - DNA, 902 bp, Homo sapiens
  misc_feature (8)..(8): n is a, c, g, or t
  misc_feature (63)..(63): n is a, c, g, or t
  misc_feature (66)..(66): n is a, c, g, or t
  misc_feature (72)..(72): n is a, c, g, or t
  misc_feature (97)..(97): n is a, c, g, or t
  misc_feature (111)..(111): n is a, c, g, or t
  misc_feature (114)..(114): n is a, c, g, or t
  misc_feature (129)..(129): n is a, c, g, or t
  misc_feature (166)..(166): n is a, c, g, or t
  misc_feature (168)..(169): n is a, c, g, or t
  misc_feature (172)..(172): n is a, c, g, or t
  misc_feature (183)..(183): n is a, c, g, or t
  misc_feature (200)..(200): n is a, c, g, or t
  misc_feature (240)..(240): n is a, c, g, or t
ggccaatnctcgcaaatagaacgtggcaagccgccggcggaagtggaaaagcgcgctgggagnagnacgagngagaagaccaggagccacgcaaaanaaaaaaaaaagagnttnacggccaaccaaagngtaaaggaagaaccgaaatgagagggaagagggagcnannagnaaattccaacnaagaaaagaggatcagnagtgggcgatcgcccattaatcattagcggacagagctcnacatatgccatatctcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337004 - DNA, 409 bp, Homo sapiens
cctggccctaacttgattctttttgcttttctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337005 - DNA, 1852 bp, Homo sapiens
actcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgccccccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaaacgcaacatagtaaccagtgcgactgccataacgaccattgcagccagtggaagctgttgtaactgcaggccaaatgccagcaaggtgccacccaaccaggcacctaatgcattgcctaaattgaacgcgcttgttaaatggttgatgccagattagggag

SEQ ID NO: 337006 - DNA, 321 bp, Homo sapiens
cccgctcagagccagtttctcccgctcagagagtttcccccgctcagagccagtttctcccgctcagagccgtttctcccgctcagagccagtttctcccgctcagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337007 - DNA, 2986 bp, Homo sapiens
gaagatgggaacatgtacaggagacagttctttcaaatcatctgtgtgaaagcgggtaaccctttgggtatttgcaagtctagagctttaggtgttactggttttaaaggtgtcaggggcagctggggctgcgtaaggtaaggtggcagaggaaaggagtaggtgaatggaacttactcacatcctaagcccacaggttgagaacttctgttcagctccctcaggggtttgcgaggctgcctttgcttttctagccccctaaacgggccccccttctctctacaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337008 - DNA, 3151 bp, Homo sapiens
tgtgtgtccctgtgtaagaatttcagggtccctgcgtccctgaaatccatcagccacttttgtttgctcgcataacctctctgtccaggcaaagtgttctttgcagttaaacaccccaataaatgtaattaacattccttgcaactttcccatcctaattgttgcagcctgggcccaggaggacaaagtttgctctgtgtgcatgtatcagtgtgggcaccagcgctgatgacctgtgtgtaatagcagtgactttgggctccgtgttctgtaatgcagtgtgggtccaggtagccctggcagtcataagagggaagatgggttcgtaggatgctcaggccctctctgaagaagtaggatatgctgctcttccctgctagcttttgtagagaatgcagcattctgagacaggctcccagttctgcaatgggaacttagtaaattgcgtaactcctattaggatatctcttgtaagctccagcattatgaatactatttggggctttgcctcataccctccaccccaggcgctctgccgatactttgcaaacatttattgcagttcgtgttagtttgtgaaatcacgagccctcggtagttgcagggcactgcttactggacgaaggggtaaatagcattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337009 - DNA, 3037 bp, Homo sapiens
cgttcgacggtgtctgccaaaggagtatctatcatctctggcgaacttgacaatcatcacttacctcgaaaccctgcccacatcactttagaaggtcagcaggatgtcctctcacccaccctgtgctggtgtctaacaaatcttcgacggtgttctgtaatgcagtgtgggtccaggtagccctggcagtcataagagggaagatgggttcgtaggatgctcaggccctctctgaagaagtaggatatgctgctcttccctgctagcttttgtagagaatgcagcattctgagacaggctcccagttctgcaatgggaacttagtaaattgcgtaactcctattaggatatctcttgtaagctccagcattatgaatactatttggggctttgcctcataccctccaccccaggcgctctgccgatactttgcaaacatttattgcagttcgtgttagtttgtgaaatcacgagccctcggtagttgcagggcactgcttactggacgaaggggtaaatagcattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaat

SEQ ID NO: 337010 - DNA, 2419 bp, Homo sapiens
actcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgccccccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgactttccattctctgctggatgacgtgagtaaagcctgaatctttggagtacgctggagatagttgtaaatggcgagatagttataaatggcgagatagttgtaaatggcg

SEQ ID NO: 337011 - DNA, 862 bp, Homo sapiens
ctggaccatcacagctcgatcaaactcaccttcccaaggcaaagctccaaaggcatcccctctccagcttaacaaccttcagtggctccctatcatcctcaaagaaagcacaacaccctcagcctggcttcggagacccacataggatgaccccaactctcctatccctcaccttccctgttgtccacattttataccaactctccaaccagagcctgctactttctgagcatacagttggccctccacagcctcaagttccacatctgcagattcaagcaacctcagaatgaaactatttggaaagaaataaccaacaataagaataatataaatgtaataacagtacactgtaacaactatttacaaagcatttatattttattagataaagccataccttgcttaaaaggggatatgttgagaaatgcatcattaggcaatgtcatcttcatgcaaacatcatagagtgtacctacacaaacctacacgacagagcctactacacacctaggctacgtggcacagcctattgctcctaggctacaaacctgtgcagcatgttaccgtactgaataccgtaagcaattgtgacacagtggtatctgtttctaaacataccaaatgtagaaaaggtacagtaaaaacacagtattataatcttatgggaccaccatcaataaccaaaatgtcgttatgtggtgcatgactgtattataagtaatctcaagatgatttaaagtgtacaggaagatgtgtataggttatatgcaaaagctagctatggcattttacataaggacttgagcatccaaggattctgggatccccaagggcaggggtccccaacccccgggccatg

SEQ ID NO: 337012 - DNA, 450 bp, Homo sapiens
cccacacccatcttcaagttattttgaagactaattctttattttgtgttgctgcttgcagttacataaaattgagacattaactagggttctttttgagggtgcaaataatacttttaaggaattcacttaacagcaaatttgtttcataagaaaacttttctcctttctttagcttctttgaaagaaaggatgccttgatggaaagtggaatcagtgggggaagagtaattttggttacagcagtattgatagggtactgagacgagaggccttggaccaccagattgtgataaagtttaaggacatagatgagaaggaaattacctggatgaaagagagttgtgaaatctgaaaggtagtttgggagaactaaaaacaatcttggatatatgtttagttttgcccagagtctatccagactccttaagatgcttaggatttggtggg

SEQ ID NO: 337013 - DNA, 1744 bp, Homo sapiens
ggtgacatcttactaactatagttcagtatcaaaacatagaaattgatgttggtacagttaatagactattcagatttcatccattttacattgttcatttgtgtgtgttagtatctttaatgcgccagacattgcttatactctggaatggaatgtggtgatacagacagttcttcaaaacactttacactttcttgggaggtgtttggttttgttttgttttgtaatgtggcctcaattctcaaacctgcctttaagatttctccacttgtcttagagagtcaagaattaaagtattccaactgcagtgaatattaattaaagaataaatatattaaagtgggttggaggcaggggaataacatgtcacttgtcacattgagccagctagttagaattctcctgacggatgcaaaggcctaggaagcttaagttcctagatagctgagaatctttgccatgagtgaaaacaataaggaacatcactacctggttggaattgccaaatttggccaggcggatcagtcctttcaaatctaagtctctgtgttggtcattttccttccagcaaggaagatccattatttaacaggtatacaatctccaggaaaacctatgaaaggtctgtcagtatcttctgtgcttttataacacattcataacacacacacaaaattacagttaaagtttcacaaaatacatacacttatggggatatgcttatttattctttcattcatttttttaaaaattggtggttattacctggtaaatcaatttcaggaccgttgtttaaaagaaaagtcagttcaaacagtagtaagaattgttaggttggtgcaaaagtaattgctgtttttgccattaaaagtaatgataataacagcctaaaagttttcataataagagctacaatttactggctacctattatgtggtaggtgattttccaagaaaatgaccagtcataacattcttgggattcattcattcaacacatagttattgtgctcctatttgctaggcattgttctagttgacagagcagtgaccaaagcaggaaaaaaaaaaattcgctaatggaatttacagtctagcagggagaatgtttaacagacacatgagaaaatcatatttcatgtcataggatgtaagtactatgaagataaataattagggaagggagataaggagtactgggatgctagtttaagtaagatggtcatggcagacttctttcacaaggtgatatctgaaggagatgaaagagaaagccgcagggatactgggtggaagagaaatcctggctgaaggtgtagcaagagccagaccttgaggcaagacacatattggagaattcaaaggataggacagtggagttatgattcaaatgcaaaacaatagactcaggacattgagctcagggtcagacttagagggtcctgaacacaggtctagctgactccaaagtcagtgcacttttacaaataaccacatgtgctactgactgctcatctactatgtgtcattttccaaactcttgctctaaatatttgatggccatctaacgttttctggttaactaaaagagtcaaattacccctgctagaaatcacatttcaaaggaaattgtcaacaaaagaaatacactcaggactacaagctttccaaacattaataagaggcaaatatgtctagtgcattactgtttcaattaattaaatgattagtgagatagcactg

SEQ ID NO: 337014 - DNA, 314 bp, Homo sapiens
gcacaagaatcgcttgaaccagggaggcagaggttgcagtgagctgagattgtgccactgcactccagcctgaacgacaaagcgaggtaggaaggtaagaaggtaggaaggtaagaacgcaggaaagaaggaaggaaggaaggaaaaaccaaccttaaactgtgtctaagaaataagaacaggccaggtgcggtggctcacacttgtaatcccagcactttgggaagccaaggtgggcggatcacctgaggtcgggagttcaagaccagcctgaccaacatggagtaaccccgcctctaccaaaaaaaaaaaaa

SEQ ID NO: 337015 - DNA, 229 bp, Homo sapiens
gaagacagaacaagatagtgtgacaagggctataatggactgctcagagcttggctgaggggtccccccaaggcagcttctcagagggtacatatgagccaggcatttagacacttactgagggcctactttatgccacgtgtaccgtgggaacaaaagcccagtagggagtgggcagcactctgagaaattcatttcataaatgtttggatgcaggaaagggtgacaa

SEQ ID NO: 337016 - DNA, 230 bp, Homo sapiens
gtggcgatatctgtcttaaagaagtggggctcaaacctggatgaaccgtcgaatactctggagaaatctaaaaaattctgatgtccagcaatcacactgaatccattgaatcacagtttctgggttaggagaggccaggttttggttttgggtttgcctcaaagctcttacagctgtttaaaatattcagaaaggattgaagatcaaccaagcttaggggctcgtgattc

SEQ ID NO: 337017 - DNA, 807 bp, Homo sapiens
ataccagcaactgaaaagcagaacaaaaacacttggatcgtaggctaactcctaaaagattgatccctggtgctgatacagaaaccatccaagaagccttggaaaagtgtcagattcccgatgatgctcaagatgcttttggccgaagaccataagtgctgagaacttccttgcttcctctcaactcactctgggatcatctttcataactctaagcttttctccatcatatgtttccaacctacactgcaactcaagcatgccaagtagtcatcaatctataaagaaatacttaaatgcattgttgaggaggactgctagtcaaaggagcctctcaggaagcttatgcaataggaaagaatcaccctgtcttactctttaaaagactttcctgcaagagaggcacaccagactcaaaatttcatgtactgtgcaaaaacatgcccaggcctttggagaactggtcttttaaacaagaattgagaccaggtgcaatggttattgcctgaatgcccagcacttcgggagaccaaggtgggaggatcgcttgaggtcaggagttcaaaaccagcctgggaaacatagtgagactctgtctctacaaaaaattaaaaaaacaaaacaaaacaaaaaaaacaaccagatgggtgtggtgacacatgcccatagtctcagctacttgggaggctgaggcaagaggatcgcttatgcccaggagttcaaggctgcactgatccatgagccatgactgcactccaacttgggtgacagagtgagaccctgtatttattgtctttaaaaataaaa

SEQ ID NO: 337018 - DNA, 588 bp, Homo sapiens
ccaaaggttcctaacactcaggatttccttcccttacagcatgccaagtagtcatcaatctataaagaaatacttaaatgcattgttgaggaggactgctagtcaaaggagcctctcaggaagcttatgcaataggaaagaatcaccctgtcttactctttaaaagactttcctgcaagagaggcacaccagactcaaaatttcatgtactgtgcaaaaacatgcccaggcctttggagaactggtcttttaaacaagaattgagaccaggtgcaatggttattgcctgaatgcccagcacttcgggagaccaaggtgggaggatcgcttgaggtcaggagttcaaaaccagcctgggaaacatagtgagactctgtctctacaaaaaattaaaaaaacaaaacaaaacaaaaaaaacaaccagatgggtgtggtgacacatgcccatagtctcagctacttgggaggctgaggcaagaggatcgcttatgcccaggagttcaaggctgcactgatccatgagccatgactgcactccaacttgggtgacagagtgagaccctgtatttattgtctttaaaaataaaa

SEQ ID NO: 337019 - DNA, 528 bp, Homo sapiens
tgtctgctagcctgaatttctccaacactgagttttcaacgtccaccctgctcccctccacccgccccacaaagtatcagacagtgttttcccaatggcaagttagctcatgcaaaagcaaagagaatcctgatgccatcctgcctatccacacactgacagaaaccatccaagaagccttggaaaagtgtcagattcccgatgatgctcaagatgcttttggccgaagaccataagtgctgagaacttccttgcttcctctcaactcactctgggatcatctttcataactctaagcttttctccatcatatgtttccaacctacactgcaactcaaggtaatctgcatatttataaatcattaagtcatcaacgattccttatatttcacctaaaaccactactgtggcaaatgcaagaagtctttttttattttttgagatggagtctcaaaaataaatgaatagataaaataaacatgaaaaaaaagctcagctagaattacagtattttaactgtaaggtgaa

SEQ ID NO: 337020 - DNA, 724 bp, Homo sapiens
tccagtgagggtctaggaatatatcccctacgaatatgagggactgttgtagttaaagctagtgtacagataaattacattaggtagtatggaaatcagaggaaaagggaaaaaacaattattactttacagttacaccaaatctcattgctatttcaataagacataatgacatgttttagaaagtatcttcaagtaatattggcacatattccctggagaacaccgctaccatgcaagctgttcaatatttattctagtggaaggaaaggactagcagaatttaaattaccatgaattgtaatacaatgtgacatgagcaagtgccttgggagggccagcacattagagacccagataattgaaggaatttgcaaggagaaagggcaggttaaggagtggctggagaatagcttatgaagaggtagtgtagcaagacaagccacagacaaaaccctcagacacccaagttaaagaaggaagggctttattcggctgagagcttaggcaagactcatgtctccaacaaccgagctctccaagtgagcaattcctgtcccttttaagggctcacaactttaagagggtccatgtgagagggtcgtgatcgattggacaagcagcggtacatgacaggggctgtatgcaccagtaatcagaatggaacagaacaggacagggattttcacagtgcttttccatacatgtctggaatctatggata

SEQ ID NO: 337021 - DNA, 260 bp, Homo sapiens
taggggctgaggcagctaccttggaccatgagatggaagtccagcattggtaaggacctgagaattcttgacccagtcatcccaagatgcactcacccagagggtcagcttttccatccttgtctggaactgtgaacacccctactactcggtggccctctttgcggaggtggctatagacttcttgtccaaagaggctctggccaattagtgccaacttcagcttgtttttgaaataaacctgtgaaacaattcaatga

SEQ ID NO: 337022 - DNA, 519 bp, Homo sapiens
ttaaaattctagagctcagaaactctcctttatatgtttcttttcattaagttgctttttcatccattatatacatctttttaaaaatcggagctcattagactggtactcacaaaacagtgagaagataaattggcatcatctctctggcaaacaacttagtgatattttaagaaccctgtaaatgttaacttctcagaatctaccttaaagaaataacttagtatgtggaagaatctttcatgcacaaagatgtctattgcagtgttatttttaataatgaaaaactaggaacagcaataaggaaataagtaatagttactgacaatatctatgatagaaaattaatgcagccagtaacatgatgaagagtatgtattcatattgaaaaatagtatgtgtacatatgtaataatctcaatgcatagaaaaatacaatgaaacgtaaaaatattcaaagaattgacactcagtaaaattgtaggtgatattccctgtctccttttccttttttctttc

SEQ ID NO: 337023 - DNA, 340 bp, Homo sapiens
ctttctctgtttgtgtttatatgtgtgtgtgcatatgtagatgggagcatctgcctctggcccaggccctgtgcatcggggtgtcggaccaggctcctggccgccttccccatctggctagcttctggcagccgtgcagggttgggactgaccttctgagaagctgggcgcgcacctacccagtggcctgcgtgagaggttcagctgcaggccctctcctcaaaaggactttccgtttctgccctccaagcttcctaaaatgtctgggctcttgcatctttgggttaaggctctgctgcccttgtagtgtctctggaactcagaatctctggggctcagc

SEQ ID NO: 337024 - DNA, 437 bp, Homo sapiens
gaataaactattaattttactgagctacaacttctaatttacataagttagaaagtttgatttcctctagattttacaatggtctggtttcttttcaccttataagtttttaaaaactattgattataccaataaacaatggctcccacaaactaatttaactcccagtcacagtaatgctgtctcaattgtttacaaatatttgattatgtgtaggtccactttcactgcaataaaattgcctaataaagacaccaactattctttttgtgtgtacatgtgcgtgtgtaattttagtgtaatactgcaattagctttttgaagcatagtaacttaaaaattatatgttcaaatgggaatacggattggtgatttaggcaaaacttaaaaataatgaaactggccaggcgtggtggctcatgcctgtaatcctagca

SEQ ID NO: 337025 - DNA, 370 bp, Homo sapiens
atgtgcacggatagtccacaagagatcttaagggatctcaccaggggcgtgtgctacacaagagagcttccactgatctataattggggtaaagcaacaccttttcaaggtgatgattatgcaaatccagacaacccaaatttcaggcccaatctgcctacagcagaattactttcactctcttcttttagaaagtacccttacaagaaatatttattaaatgtcattttgcaagtccaactggggacaaaccacataagatatgttaaaatctttaatgtcctttaatgtgctacttgttttacaactgctgaatgaatagttcaagcgctccgtcagccttataattcattttagattcatgttagct

SEQ ID NO: 337026 - DNA, 421 bp, Homo sapiens
ggtggggaggggctgcagtgccgatgacaggaaaggcctgcaggtgggacctgcctgaggagcactcccagcagagggcactgcgaaggtcctggcacagggtggaggggacaccaccagggatggtgcagctgggcagagtgagagaaaagtggaggaggtgagccaatagtgcgggtcagatggaaagccaggacttgcgtctaaaagggattactctgctgggctgagatgagactctgggggatcagggcaggggctggcaacaacctcagcaagagacgataagcctgggtgtcagagtggaggggatgaggcgtggacagactctgggcaaacctggcagggagggccagtagggtttctggtggagtggatgcggatgtggaggaggaggtcagagaggactcgtggggttttg

SEQ ID NO: 337027 - DNA, 232 bp, Homo sapiens
caaaaaaaagaatgctttgaaggcgagcaggaagtgccaccttcaagacctcagcactccaccctgaagcaggcagatccaaccaggccaaggctctttgcttcatgtcccagccgtcccatcacaggaggtgagggcccaggctgtgcgtctagtccagcagcactggaaatgtggccagtgccatctgagatgtgctgaagtataaaatccacagcagattaatatgaaa

SEQ ID NO: 337028 - DNA, 414 bp, Homo sapiens
gcagaatcacccaaaaaattctggagataatcctccagtgacttacacttcctggacaaaaattgagcttatggcctagaacccatctactgaaaagtaagcagattaaacaatacgaattatttactcaacaccaattttcttcttttttgtgactgaaagaaacccaacctggcaatcttccttgcaactaggagagtctatattacatagtgctagtaagaagatgcaagaggccgggcacagtggctcacgcctgcaatcccagcactttgggaggccgaggtcggcggatcacgaggtcaggagatcgagaccatcctggctaatatggtgaaactctgtctctactaaaaatacaaaaaattggccgggcatgttggcacgtgcctgtagtcccagctactcaggagg

SEQ ID NO: 337029 - DNA, 289 bp, Homo sapiens
ttatgtgtcttatacataactgctgctttggctttgcttgtcgtatagcaggtacttttccacttatatcctgactcactttcagaagtccttttttgaaacagggtgttgctctgttgcccagactggaatacagtggcacgatcatagctcatggcagcctcaagctcctgggttcaagtgatcctcccaccttaacctcccaagtagctgagactacagacacacactaccatacctggctaattctttttattttatttatttatttatttgagatggagtctgg

SEQ ID NO: 337030 - DNA, 316 bp, Homo sapiens
tcacttagcatagtttggtcaactcatcaagccataccctgaatcaagatgttcagagccctatcattttacagccactataaaccattctttcaaacacacatactccaaactcctccaaactccccttcccctttgtcacttatgcctgctccctccttccttcccattaatttaaatactataggtcctacaagcctcaatcaaatttaagatttactttgtctatgaaactttccatgataatggcaagctctctttctcgtaaaactcacaggaatcagttagtatttaaatatatggtacccttacaact

SEQ ID NO: 337031 - DNA, 461 bp, Homo sapiens
acatgaagtttctgtgtcagagttacagatttttctagtcacagcacagcaggcaacatgcacttcatgttcacatcgcttccccttgtctcccaaatcccataaggatgacacagtaggtctttgtcacagccggagaatcctgagcttaggagactccagtcttataaagaggtttataataaacatacccaacctttgacattattgttctggccaggaaacaaacctgccttctgtcatcttctgagactgttggttacacaaacatccttcaaaagataatccaggacaaaaactgccacaaggcatatagaattgccccgtgccaccaccacgaccagaggatattttaagcctctcaatttataacttctctctttttcctcccttgctatttatttgttgaaaagatgtctgatctctttttatttttatttatttatttatttttgagttgg

SEQ ID NO: 337032 - DNA, 414 bp, Homo sapiens
ggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatctccagggttgggctcaggactcagagctgacgcagctggggtgccccttggt

SEQ ID NO: 337033 - DNA, 426 bp, Homo sapiens
tccagcctgggtgacagagagagactctgtctcaaaggaaaaaaaaaaatcagtgctgctcccgtggctgcacagcttgtggttggtcattccaaacctgacaaccacggaaaagagaagagaagctcagaggagccagatgaaggaggaacccaccttcagggtctggtaggcctggacccggatcaggggcttgaaggactggagggtgtggctgaggggaagagaggaggacgatgtgagtaagcagagaccactctgcagcagaggccacagactggcgtctcgagggctggattcttttgcgggcccattttgtttggcccgtgccgtgttctttaaaacttggaactgaatgtctttatatggagaactcactctttccttccccacagacgtcaccatccccgttttctatcctgatct

SEQ ID NO: 337034 - DNA, 335 bp, Homo sapiens
atcccatctgtgtctcttggataatactcaatcttctttgcaaccacatgcatcaagctattggctaaatatccttgtagacaggatgtctcctacttgcatttgaactactcttttgtttaaaatataaatgcaattaatttgcattatttatttaatctgtctttgcatactaatgtcgcaaaaactgaaaataaatattaggtcatgatcaacatgcctcaaaatatctttgtgttcagtgactttaaataacttttggcaaaaaaactaaccccaactttctttgaagcttttgatgcttccccacctcctactatcctctgcgccgccca

SEQ ID NO: 337035 - DNA, 388 bp, Homo sapiens
ttcccctacgcaagctctcttgcctgccgccaagtaagacatgactttgctcctccttcaccttctgccatgattgtgggtcctccccagccatgtggaactgtgagtcagttaaaccttttttccttataaatgcctcagccttgggtatgtctttattagcagagtgagaacagactaatgcaggtcctcttcagtctctcgtggacacacctggggcctcctaaagtatcttctgctcccagcctcctcccttctcaccattctgttcctggggcattctctgtttccatcttgtgatgcttctgttgaaaaccattgagagccttctgcttcctgtgtcgttaaatccaaattcttcaccgttgcctatatttcagtagcataa

SEQ ID NO: 337036 - DNA, 2289 bp, Homo sapiens
ttttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaagctgttttctgattactcagagctgtcctaggcaatggtgctttgtagctccttggagatgtcgctgggcgtcctggcaggggtcaggcagtgaactgggagagt

SEQ ID NO: 337037 - DNA, 2635 bp, Homo sapiens
  misc_feature (657)..(657): n is a, c, g, or t
ttttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtgagtgccggctccctccatgctggcgttgccgtgaagcctccgtggggctccctcccagatgccgtcctgactgaggggcctcacacggaaccttgtgccctatctgtggtggcaaaccacatgacctgctgctcacaggttcccccacgccgcagaccgagtctcgctctgtcgcccaggntggactgcaatggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaagctgttttctgattactcagagctgtcctaggcaatggtgctttgtagctccttggagatgtcgctgggcgtcctggcaggggtcaggcagtgaactgggagagt

SEQ ID NO: 337038 - DNA, 2219 bp, Homo sapiens
ttttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaagctgttttctgattactcagagctgtcctaggcaatggtgctttgtagctccttggagatgtcgctgggcgtcctggcaggggtcaggcagtgaactgggagagt

SEQ ID NO: 337039 - DNA, 2439 bp, Homo sapiens
ttttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaagctgttttctgattactcagagctgtcctaggcaatggtgctttgtagctccttggagatgtcgctgggcgtcctggcaggggtcaggcagtgaactgggagagt

SEQ ID NO: 337040 - DNA, 414 bp, Homo sapiens
gtataattttttaaaagttataacattaaaaaaactaaataattatattcccccaaaagattcatgttgctggagttggtgcaccccctttcagacctgttctatgaatgtgtttatctaggtagatatagctctagcttcctacccacaaaaataagatatctttgattctgttctgtaatttgtatactatatcatgcaatcttgatgcacatataaactatcttacctttttttttttttttttttttccatgtgtggaagggaatgtatttaattaaccctggcgggattttggggccaaaaattttggcccagcaaattaatgctctcccacacttctggtccacggaggttacaaccacaggtatagggcaacaaaacatcttggaaaacccactcaacggaacgcgg

SEQ ID NO: 337041 - DNA, 499 bp, Homo sapiens
tacaaaatttgatcatgatcatattgtagcctctcaaagtgctctagaaattgtcagtggtatacatgaagcggcagtggtgtctggtgcactctgaaatgctatcaaagttgtacatatttccaaacatttttaaaatgaaaaggcactcttgtgttctcattctgtgcgctttgctattggagtgacaaggcatttaaagatgtttctggctttattttttttaataaggtggtgttaactatctggttattgactagaaatcctgagttatcaattgtatatctgtacggtttgtaaaaagaacaaaacaaccaaggcagactcttgacggctccttgcttggcattgaggctctgggggaagatgccttttggaggggctgtagctcagggcgtgcactgtgagtctggacctgttgactctgcagggcttccatttagcttcaagttgtcttgtttctgcatatagtgacggagcattctgctgccattcttag

SEQ ID NO: 337042 - DNA, 151 bp, Homo sapiens
ctgagcatggtggttagtagcctagtatgcacctgtacctccagctactcaggaggtggaagaatcgattgagcccagggggtggaggctgcagtgagccacgatcacatcactgcactccaacccaggtgacagagtgaaaccctgtctc

SEQ ID NO: 337043 - DNA, 413 bp, Homo sapiens
agcttggaacagcgcgagcgcccgggaagccctggccgggtcgtgcgctccgtgaggggtcctaggcgggcaggacagtcggaccgaaccgccgggctggtgccgcgagcccaggctgtcaccttcgtcccgcctcaggcgaggggttcagcgcctgccccgaagataacacaggggtccccttctgtcccggcggcccgcgagagccaaggctgcagtcccccatttatgcttcctgttgggtgtacctctctgaaagccagcagcatggagcccattacattccacagaggtcagttcccagggccccaaacaaggtagagagtggctctggagaagcaaaccaaagacacttcctcactctgtccatcaaaagcccgggagtccactgaatacactgtccttaggacaca

SEQ ID NO: 337044 - DNA, 3233 bp, Homo sapiens
gcggctgctttagaagaacaagctggtttggcagctacctcagagaagcaggaccctgggcagcgtgaaagggcctctgcccccagggtggctgggctttggatcctggatccgtgggtcctggaggggcaggagtggttcaggaaacagctctcccagtgaagtgatatcactgcctctgtggacaagacacctccaggagcccagctcacagccaccggtaccttcttccagggctgctgttatagtttctgcatggaaagcacttggaacaatgcctggttgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgaaaaaaaatt

SEQ ID NO: 337045 - DNA, 1750 bp, Homo sapiens
caggcacctgggacagggcgtgggagttgtcagaggtgacggatgggacccccgcacaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgaaaaaaaatt

SEQ ID NO: 337046 - DNA, 3181 bp, Homo sapiens
agcttggaacagcgcgagcgcccgggaagccctggccgggtcgtgcgctccgtgaggggtcctaggcgggcaggacagtcggaccgaaccgccgggctggtgccgcgagcccaggctgtcaccttcgtcccgcctcaggcgaggggttcagcgcctgccccgaagataacacaggggtccccttctgtcccggcggcccgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggttgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgaaaaaaaatt

SEQ ID NO: 337047 - DNA, 1385 bp, Homo sapiens
agcttggaacagcgcgagcgcccgggaagccctggccgggtcgtgcgctccgtgaggggtcctaggcgggcaggacagtcggaccgaaccgccgggctggtgccgcgagcccaggctgtcaccttcgtcccgcctcaggcgaggggttcagcgcctgccccgaagataacacaggggtccccttctgtcccggcggcccgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggttgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatggcatcaggagaaccctccaggagagctgggaggcagctcagagcccactgtgacagtgagtacg

SEQ ID NO: 337048 - DNA, 392 bp, Homo sapiens
gctgtaggtacagaatgagcacatgttgtggtgtacgccaggtgtgcttccaccattgacttcctaaagcgctatgcttccaacactcccgtccggtgaatttcaaacagccgacgaagacctctgctactgcttggagtgtgtggctgagtaccacaaagcaagagatgaattgccattcttgcatgaggtaaaatatattagatgggcaatatttttcagagcttgatagctgggattacagtcccccatttatgcttcctgttgggtgtacctctctgaaagccagcagcatggagcccattacattccacagagtgctgcatctctttcctccgagggttttcaaagaaagacaagccttaaatacatgccttaaaaggaagaagtga

SEQ ID NO: 337049 - DNA, 3301 bp, Homo sapiens
agcttggaacagcgcgagcgcccgggaagccctggccgggtcgtgcgctccgtgaggggtcctaggcgggcaggacagtcggaccgaaccgccgggctggtgccgcgagcccaggctgtcaccttcgtcccgcctcaggcgaggggttcagcgcctgccccgaagataacacaggggtccccttctgtcccggcggcccgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggttgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgaaaaaaaatt

SEQ ID NO: 337050 - DNA, 3408 bp, Homo sapiens
agcttggaacagcgcgagcgcccgggaagccctggccgggtcgtgcgctccgtgaggggtcctaggcgggcaggacagtcggaccgaaccgccgggctggtgccgcgagcccaggctgtcaccttcgtcccgcctcaggcgaggggttcagcgcctgccccgaagataacacaggggtccccttctgtcccggcggcccgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggttgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccggatagcgtctgggcctgcacactccagggacctgactcagaggaggtcctcggacaagatttactgaatgaacaactggaaggaggattgagcatatgtgttcatgatgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgaaaaaaaatt

SEQ ID NO: 337051 - DNA, 1402 bp, Homo sapiens
agcttggaacagcgcgagcgcccgggaagccctggccgggtcgtgcgctccgtgaggggtcctaggcgggcaggacagtcggaccgaaccgccgggctggtgccgcgagcccaggctgtcaccttcgtcccgcctcaggcgaggggttcagcgcctgccccgaagataacacaggggtccccttctgtcccggcggcccgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggttgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggtaagggccgcctcggccggggctgggagagagcaagggaagctggaggcagcagcagcagaggaagggcctggccaccatgtccctcccctggatcgccgttagaattgttctcatagctaaggctgagcactcactatgcgccaagcacttttctcacaacctcacccgtcttcattcacttaacccttacagcaaccttgtgatgtaggtactgttatcattccattttgtggttggggaaactgaagtacaaagaggttaagtgatttgcctaaggtctcccagtttaaacatagaagatccagggtcccgcagtcatgtgattaaccagcagagctcacagctcatactgtggcacccaccctctgggggccctgcctcgggtctcacctgcctcttccttctttggtgagctct

SEQ ID NO: 337052 - DNA, 141 bp, Homo sapiens
cgaagttggatagtggttacacagtccaccgggaccgtctcacaaaacgggaagaaaggagcgaagtactgacgtcttggacattagccggctgaattattcaacgactctctacatatggcacctgactgacactctgtg

SEQ ID NO: 337053 - DNA, 550 bp, Homo sapiens
aatgatgtcttttctgccactaccgccctgcccccgccttgggggatctagggctcagggccaattgggtagagcccctggagggaaaaggggtatctaggttgctgggctggcccagaatctggccaccacaatgtagaaactcaggccctcatttcagcaggcctccaaccccaccgcacgccccattctgttctagctcactgaagccacaggctgaaacagggggctacatctcccagcaagctgtaacttcagaaggcgaggtgcccagagtcctaaacaaaaatccacagactattttccatcatggtatggggagttttgtttgtttgctgttttattttttctgaaacaggttctagctctgtcgtcccggctggagagcgagaccctgtctcaaaaagaaaacaaaagaaaagacaaagacaagaaaagaaaagctacttttgacccagctgttgcttcccagtttctccactaacagcctagaccagctgtcaactcccatatcttgcctagacctcttgttgcctcctactggggcatc

SEQ ID NO: 337054 - DNA, 540 bp, Homo sapiens
aatgatgtcttttctgccactaccgccctgcccccgccttgggggatctagggctcagggccaattgggtagagcccctggagggaaaaggggtatctaggttgctgggctggcccagaatctggccaccacaatgtagaaactcaggccctcatttcagcaggcctccaaccccaccgcacgccccattctgttctagctcactgaagccacaggctgaaacagggggctacatctcccagcaagctgtaacttcagaaggcgaggtgcccagagtcctaaacaaaaatccacagactattttccatcatggtatggggagttttgtttgtttgctgttttattttttctgaaacaggttctagctctgtcgtcccggctggagtacagtggcacgatcacggctcactgcagcctcgacctccgggctcaagcaatcaatcctcccgcctcagcctcctgagtggctgagactacaggcatgtgtcaccaagcccagctaatgtttgaaatttttgtagagacgggggtcctactatg

SEQ ID NO: 337055 - DNA, 713 bp, Homo sapiens
taagcacctgagaaagtgctcaatatcattgatctttagggaatgcaaaacaaaaccaaaatgacatactataatatgtcacagtgcaaaagtcacagcattcctatacaccaataacagacagagagccaaatcatgagtgaactcacattcacaattgctacaaagagaataaaatacctaggaatccaacttataagggatgtgaaggacctcttcaaggagaacgacaaactactgctcaaggaaataagagaagacacaaataaatggaaaagcattccatgcttatggataggaagaatcaatattgtgaaaatgggcataccacccaaagtaatttatagattcaatgccatccccatcaagctaccaatgactttcttcacagaattggaaaaaactactttaaggttcatatggaaccaaaaaaagagcctgcatagccaagacaatcctaagcaaaaagaaaaacgctggcggcatcgtgctaccttacttcaaactatactacaaggctacagtaaccaaaacagcatgttattggtaccaaaacagatatatagaccaatggaacagaacagaggcctcagaaataacaccacacatctacaaccatctgatctttgacaaacctgacaaaaacaagcaatggggaaagatttcctatttaataaatggtgttgggaaaaccgactagccatatgcagaaa

SEQ ID NO: 337056 - DNA, 134 bp, Homo sapiens
gagacatctaaaccctttaccttgtaataattagactttgttaaagacgattccaatttccctcttttgtagctttgttattcactattacgtttgaggagacctttgtctttgtcttttcctctttcagaata

SEQ ID NO: 337057 - DNA, 563 bp, Homo sapiens
ctgatttcccatatttgctgcctcaagctgtcacttaacttatgcatttaatatttcacagatttgtctttgtcaactgtaagttcatccttagagaccatatcttagagttgcagtagtaaagaaaattgtccataattctcaatacctagcccttgcataatttcagaacaaggtatcctttctcaagtatacatacctaaatattataaattatggtaattataaccaattcagtatatcctgcataatgtgggtaggtgtcaagcaaataaatcaaacacacaaacaccaatatgaagactctgatagtaaattgtttttaatttaaattttctgtcatgtaggttcaacttagttctataattctgccctcactctcattagaactttctctagcaatggaagaaatgagagatctaacaaaatgctctgtttttaaattgcaaagttgtttctaggtatcagaacatgtgtgtttaggcaaattaatgtaaacagggataaaataaacatctttccatcaagaaaaagaattttgcagttagaaggaacaggacttc

SEQ ID NO: 337058 - DNA, 982 bp, Homo sapiens
  misc_feature (60)..(60): n is a, c, g, or t
  misc_feature (104)..(104): n is a, c, g, or t
  misc_feature (106)..(106): n is a, c, g, or t
  misc_feature (931)..(932): n is a, c, g, or t
  misc_feature (975)..(975): n is a, c, g, or t
ccagcctgtaagggcgagcatctgcacgcttggctccattgcctccgaggacaccagagnagggaagaccgctaccccccaagtagctgagccctccccacccnancacctagcccgtgaagcagtagcaaggtcatgatatccctcattaagagagcggccccaaactccccgctgaggccaacgagccatttttttttttttcccttaagagtccattttaatatttttaactgctacttaaaatttctcagtatcttttaaaaactgaaggcaaggaaggtcttcagaaaacagtaaccagaaaagaaaatctagaaaagtactagaaaatatatatatatatatatattccttgtaccagcccctgtaacatgttaagcttttgtaaaataatctaatattcaagaatatagacttgtcaaagatatacagaacaattaacaaattaacaaattaacaatttcttctccaaacctaaacatagcgtgcttgttccatatttatacaaattctttactataatagattgtatgctcagcttttattaaggtttttattaataagtatacttgttttcacttggaagaaaagtcagcagttaacctggatggttattcccttggaatgtatgaagtcctttgctatttcttccaagtctcatataaaacatttaaatgctcagatccaaaatattgatgacttttgaaaatgttttactgatttggacagttcagcattgattttatctacttactgatatacgggcacagagcttctgtttttttaatttggcagatagcattatatgtttttattgtccaatagagcttttaagaaaatttttgaaactccatttctggtagccaacatcttgctttctcagtctccatcctgcatgaaggaagggcatttactagaactccaaatnnccttctacactctctctctctactctccttctcctttcttacnccccccc

SEQ ID NO: 337059 - DNA, 198 bp, Homo sapiens
tgtgattcggttccatagcatgtgatagaagccccaagacaaaactggtttaaactaagatgaaagtctatttcactgccacgtaaacgaagtttaagggagcccctccagggttgatgcagaggctccaaggttatgtgagacctagactctatctagttccatcatcctgagcatgctgcctcatggtccagaaca

SEQ ID NO: 337060 - DNA, 369 bp, Homo sapiens
tatgggtacaccaagtcccacttccgggggcacccagggcaggggtcagcaaaggctttctggaagggtccagatgacacacactttgggctttgcaagccactcacggcctctgtcacatcatcctgttgctgctgtgaacgaccctttaagaatgtgaagaccatccttcgcaatctggttgtacaaagacagacccacaggctggattaggtccgctgattgtggtttgccagcccctggcctggagctttgccagtgtgcaggctggatgcccagccacggctccttctgctaggacgacctctcctctatgacagactccaagatgccaccccgagactcaccggatactcactacctcaactc

SEQ ID NO: 337061 - DNA, 596 bp, Homo sapiens
tgatcttgaggatccccaagcagttaatacagactcatagtgatacagttagatactaggtcactgtcacagctcctgtaccaaatagtccacagttcttaattatacacatttgagagaccatttgattaaggattgtctccccactgtactgtaaactctacggatagagagatctggaccactttgctcaccattgtattccttctacccagctcagcagtacatactacatacctaatgaatgaatgaatgcatcaatggctttaaaagccctggccatgctccttaccccatctcctctcagaatctgtccgagaacccccattttgaattcatctctcgattttttccaatccgatcatgcttaacctcttctctagtaggcagtagctccagagagtagttaagtcaggaaaatggtcaggtttgtgtttaaggatgaacattagtgcaaggctttgtccataggagtgaataataaaggtctgtaaaagttgaaattttggttaaatttgaaatgttcaaagtattatgtcgtgtttctaatgacatgaaagtttgagtctgtattaactgcgaaacagtgtcctgtg

SEQ ID NO: 337062 - DNA, 390 bp, Homo sapiens
gtcttacttctctttctgctttggctgccaggaatctccaagctaaatttactctttagataaagtcaccatctgtctcacctgagtgcttgcccccttcctctgcatggttttcaatcttcctgagagtaacaatcacttggggagacacttttgttggctatttcttctgattcttttgtggaagtaggctggaaatcaattataatttattctaaactcatgtactacagcctgccccatcactgttgcctggtctttctgggtagactgtattgctatccagaaaatatacagctgagcacacagcagctccccacaaatgcctgtaaatggtcctctaagacctagcctatcccttgtcccttcagctatcactctaggatggct

SEQ ID NO: 337063 - DNA, 555 bp, Homo sapiens
tcaggcatttggtccaaatggataagggagctccgagcatcataacaaataataatggcacttgagaaatagcaatacgatgtgtttgaaatgtagagggcaggaggaggagggacaagataagtaggaacatgccagatcacaagagctttacatgcaataacaactttgaactaaaatttaaagacagcaaggaacaaatgaatacatttaagaatgagcatgaattgatcaaatttacattttagactgatatctggaagtgtgtgcaattgtgatagctgtgtaagttgatcaagcaagaaagataaaggaagaagagcatggtcaaagaagagaagagtgagaagatagagttgagtaggttagccaagaaatgtattttaaatatcaaattgacagtactttaccattcatgtgtggtaggttagcacagctgtaaatcttaaaactcccaaaggtttgcaagaaaaactgggtagatgaaggtgccaataaattactacaaagaacagatttgggggatagatgattagttcaattatgaacatattg

SEQ ID NO: 337064 - DNA, 219 bp, Homo sapiens
cacctgggtaagcataaaagtagagatcagaagtaattgcttcaaaaggatatgctataatttgcttggtcaaataagtagtatatttctagaaatcctgattcagatccttttaaaaagtatagactcaggatataataatcatgtgtatcagctattcaaatacattctcaaaatccattttactaaaagttgaattttgggcatatttttgccttg

SEQ ID NO: 337065 - DNA, 709 bp, Homo sapiens
ccagtttgttgttttacctaaaaggtgttttccacgtggagtgggactgagaggcacaggtggctgaggggacccgcctgggatgtgaggcgcaggtgtgctcggccccttcatctgtcagctgcagcaatggaatacgtgctggaagtgaagaactctccgcggcacctcctgaagcaattcacagtgtgtgatgttcctctgtatgacatttgtgactacaacgtctccagggaccgatgccaggagctcgggtgctgcttctacgaaggcgtctgctacaagaaagcggttcccatttacatccacgtgttctctgccttgattgtgatcatcgctggggccttcgtcatcaccatcatctacagagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatgtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 337066 - DNA, 489 bp, Homo sapiens
caacccacacttgatttcagatctggaatgcctggcccctaactgaggctgcgtctgtgcaaatgaggctttcctgcaggacagatgtttgcctggttaagggagcctcctgtgtagagagatgatgtgggaggaagagtgttttactgtcccctagaatgcaatgagaaacataggaggatacggccatccccaaaactggcttttgaatcaatcattgccaatcagacaccatgtagatgggttcaaagatcctgatgaaatcttttcgggactgctgaatattccatttgaaaaaacaattcttcttttctaaaaatctagtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 337067 - DNA, 625 bp, Homo sapiens
ttttacaggtgagttctcctggaagaagaacctgatgccagccatctgtcaaggaagacaggaagtaacagtgcaggctcagtgtgctcggccccttcatctgtcagctgcagcaatggaatacgtgctggaagtgaagaactctccgcggcacctcctgaagcaattcacagtgtgtgatgttcctctgtatgacatttgtgactacaacgtctccagggaccgatgccaggagctcgggtgctgcttctacgaaggcgtctgctacaagaaagcggttcccaagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatgtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 337068 - DNA, 450 bp, Homo sapiens
ttttgaatcaatcattgccaatcagacaccatgtagatgggttcaaagatcctgatgaaatcttttcgggactgctgaatattccatttgaaaaaacaattcttcttttctaaaaatctagtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaattgcttctcgtccgatgttgcttattcattgctatatttttatcttaggagagagaaagcctgtggggtaggagagtgggaacctgaactttcagtttttaatggcactgcttgtcactaatattaacactatgggggctcacagcatgggctcaaggtggtgtcc

SEQ ID NO: 337069 - DNA, 840 bp, Homo sapiens
ttttacaggtgagttctcctggaagaagaacctgatgccagccatctgtcaaggaagacaggaagtaacagtgcaggctcagtgtgctcggccccttcatctgtcagctgcagcaatggaatacgtgctggaagtgaagaactctccgcggcacctcctgaagcaattcacagtgtgtgatgttcctctgtatgacatttgtgactacaacgtctccagggaccgatgccaggagctcgggtgctgcttctacgaaggcgtctgctacaagaaagcggttcccatttaggggaggaattgacctgggcattgaggagccatttccagggagctggggagcacagcaggaacagaggggccagcgccatctctccacgcacccccaggggtcaggagccagcaccatctatcctccacacactcccgaggtttacatccacgtgttctctgccttgattgtgatcatcgctggggccttcgtcatcaccatcatctacagagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatgtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 337070 - DNA, 112 bp, Homo sapiens
tacataatttataaggcaaaaaaagcatgcaagtgagaaaaaattctgtgtatgtttgaaattatgccaggattaacctgaactgaattttaagttatttgttatgatcccc

SEQ ID NO: 337071 - DNA, 117 bp, Homo sapiens
atatgcaaaggcatagaaggtgctgagagtgtcaagatgtgaggctgaagaagggagccaggggcatttggaaagctgtttattatctctgacttcagttttctcgtatacaaaatg

SEQ ID NO: 337072 - DNA, 399 bp, Homo sapiens
gagttgtccaaggaccttggggataaggggacggggcttctctgctgatctgatggttttttcagtaccacccttcagttatctgtagcaggatcctctgctgctgatggccaaacctcagtgcccactgggattacaaattggggaggaagagggggacttccacattagggatcagcagggagcctccagaatggagtaggagatacctacggccatcatcagaggctgccgcagccccaggttcagagcagtcatcttagctgatgccatggaaagcagtagaccagaagtccagtccgcagtgtttgctcagcacttggcagaattgtatgaccttgggggtcacttgccttgtccgcgcctcggttccccctgtgaatattgagcgagttgcat

SEQ ID NO: 337073 - DNA, 557 bp, Homo sapiens
tagatgagtttatccactggggggtaatcctagagtacatatctgtgggtggttcttgacaagtgtgtaaggcctgggacatctggctttgaggcagttctttctccaggttttatttatgcgaatccactcatctggcaggaatgatttgttggtgtgaaatcaggtgttggcccagcatcctgcacatgttccatccacatggcagtgatggtcattgcacaccagtgcttggtctcccaagttctggagagtgtttttatttcactgccatctaatttatccagaaagttcaagtagcgtattttctgtagattcttataatttcaagattaccaggtccctgtgtgaactctcagaccacatcctgttgcctttctctgtcattctattgttttctctcccaggagggctgggtggtagggtatttattaatttattgccccatatactaatgagttccttcctagaactccttacaactctcagtccatggcctgttgtccatctttgctgtcccaggagtgctggtaggtagagtatttaatgatctcttc

SEQ ID NO: 337074 - DNA, 555 bp, Homo sapiens
gagtaaggatggaagttaacaatgcagaaggcttagggaggcagcaaaaggtgagaatttagaaaatttagtgcagaggtttggcagtgaaaggaaggaggaaaataggagagcacctggaagttgtaacggaattaaataaaaacttactttctcctcctcccacacaaaggaaagttatgcaagtatcatcagttgaagataaccacctctttaggcctggaatgattgtgtctctcagttttccacagaaatttagagacttaccatcaatttccactttgtccaaataaaaaacacccagcgattgagcttaagttctgaaattcagactgctaaatgattgtgttcatcaaaacactaagcagctggctgttaccatgttcccaactcacagtgactattcataccatgagccactgtgacttgagtgtgctgtcacatgagcattgccagcaaagcggccactgcagacttgtaaatctacctacagatttgtaattcacccatagctacctctcattcatttactgtcactcttccttcctctggcaa

SEQ ID NO: 337075 - DNA, 242 bp, Homo sapiens
atcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccgtcatctagtccctttt

SEQ ID NO: 337076 - DNA, 232 bp, Homo sapiens
tagtagatcgagccggtacccctagtttagaagtttcaatagcattgtcacccttctctccataacagcattcagtcattctctaggtctttgtagttccatatccaaaagcattttcagcattattcccttagtttcctttctaccacaattagttcaatttctcagacttatctttctagattgttgcaaacctactaagtgattcctggctattaatcttttttttttt

SEQ ID NO: 337077 - DNA, 570 bp, Homo sapiens
gatatttcgttttccttgctttgtgttaggacaagaatgcttcagctcttaatttaaaattatgtttctccctcctaggttgagtgaacttagaatgcattctctgacatatccaagattttgttaatatgaatttcgggaaaaaagcatacttaattagctaagacgtcttattctaagcttgaccctatgttcgacatcttttgaatttctggttgcgtgggctgctctctgacactggttagtgacctggaagctctattaatgttaggggaggtggtgtatgagcattagaggtatccttgcaaggaaagacttgtcttatctcaatacgtctttttttttgcacacaagaaagtcaatgtctgagtcttctaaaatcttcctatttccaaattgcagattatgattgattcctaaacaaagacctaatttttgactcagagacgtggcaagctagtgaatcaccgttataatttaacaatcttcaagataaaattatctctgatatttagattttgcccaattattaagatatttgggtgtttcgttaagaatggaaaactctag

SEQ ID NO: 337078 - DNA, 328 bp, Homo sapiens
ctggccctaagactatctttatctccctaggttggtgaacatgtgaaaaagatgaccgtccaaattcctcattctgattcaagttccttcctgagctggtcccatttcccctgctcactcagccagttcagtcacactccacggcccaggccaaactcagtctcgtctctcactttagcctcccatggctcccttctttgggcgaaagctctgctctacaaaaatggatgcgagcacaatataatacccttcacgttggacttgtatagcttgatccacgctggggaatacccgggggacccgaagctcgaattacgtaaatcatggg

SEQ ID NO: 337079 - DNA, 157 bp, Homo sapiens
tgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatc

SEQ ID NO: 337080 - DNA, 322 bp, Homo sapiens
ctcttggccaccaattttggaaagtaggaataagatcagattttaaagtttactggcatattctaactgtattagactaaccaagcatggtaattagttttcagacatcctcaccatgaagcataacctccaactattcacagtggaaattacactgtgtgattaacttggagcttctgtgtgggccttctgtatcactaaagctggggaagtacaacttccatgaaagaattgcaactactatgagatgcccaggctatgagcaacccaatctagccatatagagaggccacatgaagcaagagatgctccactggcccct

SEQ ID NO: 337081 - DNA, 481 bp, Homo sapiens
attcccttaaatacaatatggtagattctaattccaattatctcctaaattatactttctccatgcctcctctcatgcctctctgaggtagagtatatgtcttcactccattgtcaggctgtgtgacttgctctggaatgtaagcatgtgatataagccacatcctaacagaagctttaaatgtgcctgcagggtcagtgcagcttctctcacttctgtcttctgctatgagattaacatgtcccagatgtgggtactttgttaacctgggtccctgaatgagaggacatagagaatacagccaatctgaaaaaatctgacccttttaggctgggcacggtggctcacgccagtaatcccagcactctgggaggccaaggtaggtggatcacttgaggtcaggaatttgagaccagcctggccaacacggcaaaaccccatctctactagcattacaaaaattaggtgggcatggtggcat

SEQ ID NO: 337082 - DNA, 107 bp, Homo sapiens
ggaagtgaggtagtaaagcaggacagttattgcacaagtggtatagtttaatatctaatatgtgaaacttacaaagaagtagtttggttttactaatgcttacattc

SEQ ID NO: 337083 - DNA, 404 bp, Homo sapiens
ggaattcgaggctgcacggagctatgattgcaccacttgtacttcagcttgggtgacagagtgaaagccccatctctaaataaataaataaagagaggtcctgattcagtttatcaatcccatgtaaactagagagaaaacagcagaaaatttatgggtgaaacctttggtgatggttaattttttgtcagtttggctaggccacagtattcggatatttgatcaaacacatctggatgttgctgtgtagtttttacatgagattaacctttaaatcagtagactttgagtaaagtaattaccttcctatgatggtaaattttatgtgtcaatttgactggaccatagggtgcctggatatttggccaaatatcattcagggtgtgtgtctctgagatgaaatt

SEQ ID NO: 337084 - DNA, 223 bp, Homo sapiens
gaggctcaggacaaaagtattcttctgttgtctttaaaggtaaactagggtgtcttggtgccccccagaggacactctgagattcaacagcgatagtctcatctttgaggcacagcattggttggagctataaactgctgtgatcttgtttggagaaaatatgttttttattattgatttgaaatatgttctcttatttttatcctctctccctaccagtcaa

SEQ ID NO: 337085 - DNA, 269 bp, Homo sapiens
tgtagactggtgtgaccttttagaatattttgggaagagaaaaaatggagcatttattgcagtcatgtggaaactctgcttcaatatgatatgcaactcattacatttaaaattccatttgggtaactttcacactgtggcatttcttgagccctctctcacatgtcaaagagatgcatatagatgggaaactatttattcaggcaacctcaaatggtactataaatatagttgtaaaatgtcaagttatttgcacgctggttattccg

SEQ ID NO: 337086 - DNA, 201 bp, Homo sapiens
tcttttgttcagttgtgttcagctaaaacatggggaaaacacctctgtcatataggttttatttgcctgggacatgctgtttaaaggtaaatgaaacagggtagctaattgtgaggtttctcttcagtgtcctcagacttctgtctgttctttcgtctgcttgatagcccatcatctccatgactgttccccactttaaga

SEQ ID NO: 337087 - DNA, 127 bp, Homo sapiens
ttatccttattcttcaagagactcctactcctaatagcactttgaatttaacctccctggtagttcttctcagccaaatttcaccttcctgaaaacaggattctctgttctccttgtctccctagag

SEQ ID NO: 337088 - DNA, 167 bp, Homo sapiens
tcggcactcgctatcatcggcacctcgcttattcatcgggcacctcgctatcatcggcacctctgaccttacgggtgtttgactgtaggtcataacaccctcattccagagagtgtcctcccttatacccagaaggaaggagtattgaatacatgcccagagaggcc

SEQ ID NO: 337089 - DNA, 612 bp, Homo sapiens
ggatttttctatctgtacgtgcagatacaacacataacattatctaggggcattcaatgtgtttgttgactgctatgagggtatacggtgcaaggaaagaaaacaggagcagggacaagcttggcttctcaaccaccatgtggcatctctgtgtggctctgtaaagcagtgttgtctttggaaggcagcagtgaccccagtgtttacagacgggatgcatccctgagagccggattttagctttgtgcatcactcagatgcaagcagctgtttacctagaagtgcattttcacttcgtgtttgttgtcagagtgtttatgaatgatccatccattaggcactcccatgatgtggtcatcaacaaagcttctaggtctctgaccattttgccaaccgtacaatcagctttcacaatttacacataactgaagcctgctaacaacccatgggacctagagaaacagctttcttgatagctcagatgcagaatgtggggatctgggtaatttacatagatgggtgtcacctgtgatgcctcctccctcctaagcctctggctcaatcctacctcaggctgttggctccttggagttcttggcctggactacgacc

SEQ ID NO: 337090 - DNA, 342 bp, Homo sapiens
agatttgaagatggaggctcagaggggctaagtaactagctcaagactgcacagttagagaaacagcagagttaggacttgaactcagcactagtttcggccagtggctcttccagtggaaaggagtaagaagaaacagaacaggatggaagagaagagaaataggagaatgaagtgacccaggtaggagcctgtcgtgctctgcctgcctgcagaacaaagttcaaactccttcacctggtacgcaaaggtctccttgatccagcttctcttctgttaacccattcctggatcccctgcattctatgctctgaaagggaaaatgatgtcagattcagggct

SEQ ID NO: 337091 - DNA, 352 bp, Homo sapiens
ggtcctaactgtcctcaacctgctgtagtattttcatcttttgcattttggccattctgatggctatgtagtggtgtaccttatagttttaatttttatttctctggtggttaacaaagttgagccccttttcctattttttttggctgttgtatattctctttttataaagtggctgctgaactatgtttccacctttctattgggctttctctattttcagcatcaatattgaaacaatgagaattattattgagggcctatctggaactatgtttgtggaggtagagaagagaacaatatagtcatactctgtacctcaagaaagcttggctgtgtgtaggaggagtga

SEQ ID NO: 337092 - DNA, 353 bp, Homo sapiens
ctaggtgctcagtaagtatctagggaatggacgagttgtaacattcttcactgtgttcttgctttctcttcctttgtcgctttttcctggcccaaacgagtccagtgtcaggattcgaaatagaaaaggattagtcaaggcttgtggggagaaggccttgtccctgaaaccaagtcacaaataagccttcagtacgggcttttgacaatgcctgggtgctctagggaagccattaaagagggaaaaaaccattttttttttcagtgaaaagtctagtactttggtatagttaaacatttcagaggatggcatgtctgagcccccaacctagcgcctataggtcactgtagtca

SEQ ID NO: 337093 - DNA, 861 bp, Homo sapiens
atatgtcctgtaattgacaggtcatcatttaggctaaggtattctgcctttaaaagtctgcagtcatcttctagggcttaacaccatgcttcccgttcatagattataaggtgcttagtgggtgatatttttggcctatgtggggccttcatattatggagcattcgtgtgttctgtggcttttcatgtagtgcgtgtggtcttcctttttcaggagcagagtagagtgattattagtaattatgattatgagtaattatttacaaatggatgtgagcccttggtgtatacactaaatgaaagtcctatgagttgaatcagtacttttctgagatgcattgtgaggggaaggaactgtgcttgtcttgctgaccattgatctccaaggcctaatatgctacttgacacctatcagtgctcataaatatgttttgaatgaatgaatgaatgttcaactaacttaagccttccagtttagcttcagaggctgtaacatggagctgagaagagaagtaacgagtaactacaccagtggctttatagttcttccaaggaacgcagtctctccaggggtactattgttagctctgtgactctgatttctttctggtaagatatgtagcaggaattgttacacttatttgatgacagattgaaaaataaagtcacaagaagatttggtgctcaggtcatacagagagagttggaagtatacatcaaatggaagtagttgtttctattgcattgtgcagtcatccatgataacttcttttttttttttttgagttggagtctcgctctgttgcctaggctggagggcagtggcacgatctcagctcattgcagcctctgcctcccagg

SEQ ID NO: 337094 - DNA, 346 bp, Homo sapiens
ccatgtcgagaagtggttaagagagtggtgtcatatacaggctgccatctctctgaggtttctccttttgtgtaggaagagctaaattaagtggtgcttcgagcaagaggaggtcctgcagagaaacaatgcatacaagtcatcttggcacaggtaaggggtggtgactagcagggctagcagctgcagagtaagtaagggccaagttctcagtggagcgcataaagttggggtgggccagatcagctttatataagacatttttggccaggttcagtggctcacacctgtaatcccagcactttgagaggccaaggcgggtggatcacaaggtcaggagttcgag

SEQ ID NO: 337095 - DNA, 95 bp, Homo sapiens
tgctgggattacaggcgtgagccaccatgcccagcctgaaaatgtgatttttttatgcagatgaaaataggaccacagtgaaggaggtagagaag

SEQ ID NO: 337096 - DNA, 213 bp, Homo sapiens
gccccatgctccgtgagagccttgacctgggtcagcaggggcggctgggcttgactcgagaattcccacagggcccgagggaagagcagagcaagagggaggagcgcgtggagccctatgtggcctgcgatattggggtggcgtccaggcccgcctagatgggggagggagacaacagagctgccacctgctcaccgcagacccaggggccca

SEQ ID NO: 337097 - DNA, 703 bp, Homo sapiens
cattatccactcacaccctttgctatggccagtgtgcccaggaatgctacatgtgagacccagacagcctctgatgagtccaacacctctactggggtatccacacatgtccctccatccccaactcagtgaacggcaccctgtcattgccacacacagagcctgggagccaccatcagctcctctttttaccctacagccaatggctaactcctaatatcaacccagaccttctctttaccccttgccatttctggatccagaccgttcatggtctcaggcccttcaccccacttcttaccagttctccttgcctcctggtacctagcacaaagccaggaatacgagatgcactaacaaaatgcaaaaatagtatgtatgacatgtccctgccaggcgtgcccaactcagtcagcccactagggccaacaggcaggaaaatgtccacactcgggcccgggatactgcctcgggccttctgccactgcactcacgtggggccggtctaggcctgtggccttttgcaaactaggggcctcattaagggaactaattctcagaggagcacaaaaccagacatgggctcggaagcttccagtgcatcctctgcggtaacacgtcttgctcctcggcaccccgcctgttcccagctccagctctgatgggccccagtgtcctatgacccctcctctgtacctccttc

SEQ ID NO: 337098 - DNA, 491 bp, Homo sapiens
ttagcctgtctagttcacattggcctggaggctagggcaggtagtgacatggagcaaacttatggtagttagggttcttctctctcttccttgaggtctcagctaaaccagtgcctcctccaggaagccttccccacctcagaggctgcactgtgtgctctttgtgcaccctcggagcaaccctcccaacacctattaacgctaatgcagtagaccagcaaagcgtcttatctaatgagcacatgaagaaagaggccaagtgtccccaactgacccccaccccaggaccacacacagccagggacacactaccagactctcttcatgacaccaatcttttttggggtgcatcctagaccccggatggtaccagcaacagaatgtcactaagacacagccctgccttcatgaggctcacagtctggtgtgaggggcagaaaaatacacgaatatgcaaataatcaggtggtggggaggtgggaggagaggaa

SEQ ID NO: 337099 - DNA, 422 bp, Homo sapiens
tctgccccgatctgcccccacctcttccccgagttcctacgctccactcttgctccctcccactcaccccacattcagcagctagagggatccccaacgctgaacctgtctttctcctgctcagaacctttgtggctccctggtgttcccagcaaaaaagccaaactcctcagctgaggatccaaggcccttcaggacctcgcctctgctgccctgcgttccaggtgcatgagctgagacgtgcacctagaaagccctcgggaaaggctaaggaccatgacgttgactattgcacctctccagcctctccgccctacctgactctccatgttacgcttctgtcactcaagcccttccctctggcctccatcagggacagcacctccttctgggcgttcttctctctcttccttgaggtctca

SEQ ID NO: 337100 - DNA, 287 bp, Homo sapiens
ctcaaggcagcatcctcaaataacttcccattaccttagagtatttgggtacagaatggaaataagaaagtttgtgtccagctcaaattttagtttttggcagatcttacattggcattttgttgctacggagaaaacaacatttaaaaggataagctgtagaaaatgtataaaaattgtttttttatatattcatattgttaggaaccacaaatcttgtttggaagtagccagaacttaaaatccttaatacctgctgtatttaatattcttttcatggtctagtt

SEQ ID NO: 337101 - DNA, 308 bp, Homo sapiens
gggctgtggaggtaggacggatgggctaaggggtgcagggtttatctctggggtgacaaaaatgttctaaagtttactgtggtaatggctgcacaactctgaatatactaaataaaagccgccgaactgtacactttatatgggtaaattgtatgttgtggcaagtgaattctatttcaataaagccgctaagcaaaagtgactgcagggcacttgacagctgatagccacttccccagtaaaataaaaattaaaaaagcagaatgagagtttccaggagcccccaacttaacagctggttacacggc

SEQ ID NO: 337102 - DNA, 396 bp, Homo sapiens
ccccatcctgtctcatctcccagcctccctgccgggccccagcactcaggtctggcctgtcccttctctgcccactcgacacagtgtgcccagaactccttctctacctaccaaataaggattggtgcactctgaagccctcctggatgtcccatctgacatcgagcccctgcccccatctcttatctgaattcctgcagccgattgcacctgctactctttcaggaaccaccttccattatcaagagctgggaaaactggcgaaagtttctaccttgctcttcactgctgtttctgcatctcataaaatgctccctacctcacaaggttgtgtgaaaagtaaaatgagaaagtgcatataaagtgcgaaatacagtgcctggtacatagttcaca

SEQ ID NO: 337103 - DNA, 200 bp, Homo sapiens
aaagatacctgcacttgcatgtttattgcagtgctcttcacaagagtgaagatatagaatcaacagattctatcaacagatgaagtgtccgtcaacagatgattgggcaaagaaaatgaggtatagatacacaatgaaatactattcagccataaaaaagaatgaaattgtatcctttgcagcaacatggatggaactgg

SEQ ID NO: 337104 - DNA, 624 bp, Homo sapiens
tgggattacaggcgtgagccactgcgcctggaccccccaaaacacttatactaccattctgggaaacactgtttcaaaggatactggcttgttaacagctcttctaggttattctcattatatggatcaattaaaattatttttttgttttgtttttatgaaaggttcttgatcctcttgcctcagtctcccgagtagctgggactacaggtgcacgctgccacaccgagctaatttttttttactttttgtagagacagggtctccctatgttttctaggctggtctctaactcctgggctcaagtgatcctcccaccttggcctctcaaagtgctgggattacagacatgagcgaacacgcctggtctaaaattatttaatgtcctccttagattagaaatttcttgagacagagactatagtgtctctatatttctgtgtcattccaattccagctgttaatactaacataaggtaaggagctatactttacttgaatgaaccaaacatttaaaattgtgggaggctgggtgtggtgaaaccctgtctctataaaaatttttttaaaaattaaagaaatttaaaaactaggtgtggtggcatgcacctttagccctagcta

SEQ ID NO: 337105 - DNA, 262 bp, Homo sapiens
gctcagtctcctttcaggaagagaacacctaacgtcggggcaggaagcctaggggacgtttgttcctagagagggaaatggaacagtgctttgagattgtttccctttcatcttatcctcagctcccatgcctggccccaccctgtcctctgataagcagagggtgtccatcagtcatcattcaactcacagctgccccacatcctgggtcaactcacagctccctcacatgcggggtccatcttccaatctttcccccatg

SEQ ID NO: 337106 - DNA, 393 bp, Homo sapiens
tcaagcctggttgacagtgagaccctgtctcaaaaaaaaaagaaagtagatttttaaaattctgtaaaccatacatagatatggaaagatatcttggaagtattattaaatgacaagagcaagttgcagtgtagtatatacaatattctgtttatataaaaagcattatatacaagtggttgattcaaaattaacaatgtaatttataaaaacaataaagggtactagaaaagctataatttcttaaaattccccacataacaaattatgaaaacctggaactccctaacatacaattatcaaagtcaactgtcaaattgtaatggccacagaaacactctgatacacaattaaaggtatttggtcaaaacttgccatgtgctgggtgtggtg

SEQ ID NO: 337107 - DNA, 400 bp, Homo sapiens
ggcatgcgccaccatgcctggctaatttttgtatttttagttgagacgggatttcaccatgttggccaggctggtcttgaactcctgacctcaggtgatccacctgcctcggcctcccagagtgctgggattacaggcgtgagtgactgcaccaggccggtttggagattttaatagcttcatgtcatgcagcatgagtcagaggcaagagctcagaccaggtacccaaaaacaggaatgccaaatctcgtgccctgagtaattctgtgtcgtagtaatagattgctgtggattcatgagtaatttggggttattttacttccttggcaccaaattacacactcaaaattgacattgttgatcctatccaatgttcttctttttcaagaaaaaaaaaaaa

SEQ ID NO: 337108 - DNA, 346 bp, Homo sapiens
actccagactgggtgaaagagtgagactcataaaaaaaaaaaaattactatcttaaccatgtaaccatttttaagtgtattaggtttcttttgtagtagcataaaaattgagatatgctgtacataatctaaaattcacaattttaaaatgtacatttcagtggtttttagtatattcactatgttgtacaatcattactactatctaatttcagaacatttctggaaaatctgtacctattagcaattagtcccagttattctcctaccccatgccaaggcaaactctgttctctgtctctatggatttgcatattctggatgtttcatataaatggaatcatac

SEQ ID NO: 337109 - DNA, 717 bp, Homo sapiens
ttctcccttcctccttctcccccaagcatgcttttacttatagttgaaagccacagtctctgcttaataccactgaatgttaatctggaccaacaggttgctgtcctctgccccttacctggggagctttcataaaagtaaccagtggtagctttgtaatatcaagccaaacctaagaagcacaaagttctcacaggctgagtgatttctgaacactacccaagtcatcacaagtgtccattttctctggtcaagcgcattcattttcatcatgattctattaagcaaaattcaggcccggtggggtggctcacggccaggcagagtggctcacgcctgtaatcccggcagtttgggaggatcgcttgagcccaggagttcaagaccagcctgggcaacatagcgagacttcatcgctacaaaaaaatcaaaaaaattagctgggcatggcagtgcacacccgtggtcccagctactcaggaggctgaggtgggaggatcactcgggattgggaggtcgcagctgcagtgagctgtgattgcgccactgcaccgcactcccgcctgggtgacagagtgagaccctgtctcaaaaaataattaaaaaaacatatatgtgcatttttagttgagttgttgtttcctaaactctaggttagtgtaggtgcctgccattccaaatatcttctccaagacgccaagcgaagatcctgtagag

SEQ ID NO: 337110 - DNA, 355 bp, Homo sapiens
ttgccgggtaaagagggcagaggggcctggcaggtgtggaaccctcccagcagctcggggatcccaggccccacaagcatgtacaagtgggatggagaggggccaggacaatgtggcttcacatttactgggaatggttgggagctgctgaggcactctgagtgccaggcccacggaactcagcttgcatttggacaggcttgcactgctgtgctggtcagaaacttaacctctgcactttggggtaggtgggtggagtggctgaaattagagacagaccagcgatcatcctggacacaaactgagggggggtgaacagagacagggagtagggaggggtgggactgattagcag

SEQ ID NO: 337111 - DNA, 244 bp, Homo sapiens
ctccaaattattcatttcacattttcaagcttgttttgaaactttggtttatctcagttatattattgttagcatctagtgaaaatgatgatacagctggataaagatagagatcgatagatagatagatgatagatagatagatagatagatagatagatgatacatagatagacagagagatagtgatagagatagagatctattttttttttaaacagagtctcgccctgatgcccgggct

SEQ ID NO: 337112 - DNA, 478 bp, Homo sapiens
ttcttaccgtatatatccaaagtaaatgaagttgagatttgatgtcatcagtagcccatttgattatctacaagaatcagataacaaactggtattatgggggagagatataaataggaaatcagtgataaagaagctgtagtaacatcagtgttggagaatctttatttattatagggttaacctcttgtaccgtaatggaccttaaatgagcacagaagtctggtctccaaagtgagacctaaaggaagatgatgccaaccagagcatggaggacagactggaagttttcccctggcacaggccatcagtaatcagctgttgatatgcctatgttaattgtctggtaaactcgtggtgctgttttggctcttctcaactagttcactttttaaaaatttaagcacctcattaaagaaacccttttagatgtggtaaagcgaaacagtctactaggtagggccctactaagtaacga

SEQ ID NO: 337113 - DNA, 133 bp, Homo sapiens
gcaaattcctcaggctattttctctgggctggaaaggtctggaaggtgactgtgaaaagtatagttgaactaggccttaaagagcagtagaatttagctggattgtgggtgggaagacatctgaagctttgaa

SEQ ID NO: 337114 - DNA, 211 bp, Homo sapiens
aaggacctatgcggggggctgggatctaccccaggggctgagtaaagaaaccaggccacggtgtaatgcttctgcagttgatcacactagagcccgacccaaaaccccaaaccactctccatcctccccagcctcgcagactgctggcttctccaagccacctttccttctgtctgtctcctctgctgagctccatgtgccgctccttctc

SEQ ID NO: 337115 - DNA, 528 bp, Homo sapiens
tgccactgggccttgcacctgatgcccccagggagctcagcagtagcaagtgtagaagtgccggtgccaccttctcctctcagcccgcttaccctccacgtgactttctgtggtcaagtcacgccatggaccccatgtcctgagcctgacattcatcctgacctcttcgctcctcttcctcctccctgagtcccagccatcaagagcatcgggctgagtcctcattggtctcactgcctccggttcttccctcctctgagccatcctccaggtctcatcataacccctccgccctccagcgggtcctcactgctcctagaaaaaggccataggcccagaattctctaaggagggtgtgaaggtctcaggtgatttgactgtaccattctttgccaccacattgctgctgtcctcctgtaatttctaacctgcttgaggtgcgtttctcaagcacccattgagctttcatgtggttcccactgggattcctccataggagggttttcttgatgccccaccccaccccac

SEQ ID NO: 337116 - DNA, 107 bp, Homo sapiens
atgttaaataagagaaaatattcgcatctgactggggactaatatacagaaaacacaaggcattcaaacaactccacaacaaaaagaaaagacttacaatcccatta

SEQ ID NO: 337117 - DNA, 270 bp, Homo sapiens
gactcaggagaatagatatcgctgggcaatggaggatatctcatcataccccccttgagcagtttgcttttatcatgactttgagcactatcctttatgtctctgttcctcaatttctccagttataaaataggaccatttttacatcagcgcctcctctccctgtcttacaggggtttgacaaggatcaaatgagttgctttaaagagaacatgtgagataagatatctcctcacagtaggtttccaggatcctgtccaggatgatcac

SEQ ID NO: 337118 - DNA, 406 bp, Homo sapiens
ttggcagactgagaatttggagcagagtgtgagtgccgagcctgggcttaagtctcaaccccagaccagactgcctttccaggccacctatgaaggatggctgggcagatgctcctctggcacctgaggctgggtagcagcgaagctcacctttgagatgaggtaccacctcatgcctggcttgggcattcatagtcattcatagtctccttctgacacactcagctggaaggagataaaactccagtttcagcagaacgttctcctgttgaactctaatctgagtctgtcctccccagcagcatccacatacttcccaaattgtggtgaattaaagaagctgcaagcactggcccaactggcttttgctggtggtttttcggcaaccctcctgcaaatgctgtca

SEQ ID NO: 337119 - DNA, 376 bp, Homo sapiens
ctagatactggtgatccctgattagcacatattcttgtggcctaattttcatgagagatgaattactgtcagaagcttgcttggtggacatggacatagaattcacagagcaatttggatgatcttaatgaccactgtcaaggtggtgtgagaagctggttcatttgtcttcactgtagggggagacccgaatggacagtttttctggacagagccagatctaaaggtccataattgcatggccaagtctttcctaggcttctgtgctggagctcctcctaccctcctctggttgctacatactttcttgtacccttttctcctttgcattatttctgtggttatatcatttcttcaatcagattaatataaagtg

SEQ ID NO: 337120 - DNA, 381 bp, Homo sapiens
gtaggggatggagttattgaactcctgaagttccattcagcccagagtttaggaaggaagtcttctaggaagaggactggggaacctccatgtggtgaaatggctggaaatggcttctcgtgctctctaggatagagaattcatcccttcactcatgtaacaaaagccgctgagctcctggtctgggccggtccaggaccagagagtagaggggacagacaggtgagatgtctgctctcagggatccgagcttggtggggagtacaaacaaggggcaggggcagagaaggagaggccacacctcctgtagtagggtaggcggggacagtctctctgcttgagttgagctttaatgggagaggaggacaggagttcatagtc

SEQ ID NO: 337121 - DNA, 192 bp, Homo sapiens
gcccttagcttttaagagggtgggaagggcagaagggaatggtcatgtgggtttgcagaattggggttggatgagaattcaactgggtttgttttccaaaagactccctagcttactgttcccttgtttttcctgcttgggaaaatggggaagccggtgtcgcccaagtgtggaggagcaaaggacttttct

SEQ ID NO: 337122 - DNA, 439 bp, Homo sapiens
tctctacaaggtacatatacattaattatgtccattcttttgttatgtatgatgcgtttcaagataagaaaacaaaaagaggaagtggttaagtacagagcagctcaaccaaagctttataacagtgccaagaatacactccagaatttcagaagaatgataacaactttcaagtcttggcctcttctagtgcatgagacattatttaaccatttattttaagtgtataacccatcttatacacaggtctgtgtggtaggttattaccctcatttatgtagtgggggaaactgaaacacagagagtgaccaggatcaaatccaggtagtttggctctaaagcccttgttcttggccacttctctactccccatatcgtattaccatagaaagagcctacatgtaagtttgcatgagttcttacattgaaaggatcaaca

SEQ ID NO: 337123 - DNA, 298 bp, Homo sapiens
acttcatggaagagtggctgatgactcaagccttggcattagtcacatctaagtttgaatcccagatggttcacttattagatctgaaatcttggatcagccattcctaaggctccgtttcctcatcaataaaatggggatgatcatatcaaccccacagagttgaaaaggtttaaacaggataatgtgcacaagtcctgcccctggtgttcggtagagaatattttgactccttgagtaatgggagttcttttgtggtctctgctagggttgggatggtcagtagcatgcatttgta

SEQ ID NO: 337124 - DNA, 426 bp, Homo sapiens
acctggcattcccctttcctcccacagcacctaggtgggggcctgggggatgcatagacgctttgctcgagtggagaaaagctgtactgggcagggcaatgccacagggatagtgacaaacacggaaaagcatttttctcctacattgcctcgtctggagcgtcagctgggacaatgctgggggcatctttccacagtcttaatgaggaattcagccccttaaaaatcatccccaaactaaacacccctcagttttatatgccatggctttagttcccatgaggtctgtgtgccgcttagcatgaggtcagtacatgttcatcttaatgctcttcttggttttttgttaaccgacgctaataaatttttacaagggctgtgctgttctggaaagtataaaagtgaagcattaaaaaacggaaccct

SEQ ID NO: 337125 - DNA, 504 bp, Homo sapiens
aggctgggtcccatggctcacacctgtaatcccagcactttgagaggaggatcacttgagcccaggaatttgagaccagcctgggcaacaaagtaagatcctgtctctataaaaaataggaaaaaaaaattagccgggcatggtgatgtgcgcctgtggtcccagccgcatgtgagactgagctgggaggatgacttgagcccaggaggttgagggtgcaatgagctgtgattgtgccattgcacaccagcctgagtgacagagtgagaccctgtctcaaaagggactttaatcgcctgacttcatcacagtatatgctataactgggtaaaagtgtgtgtgtgtgagagagagggattttcagtcccctccttctcgtgtaagaaaagcaagtgttactttctttactctcagtgaaattgctgtcgttgaaatggattatttaagtcatcttgtggagtagctatatcagcttgagtttgtttccagattgaaatttggcaa

SEQ ID NO: 337126 - DNA, 425 bp, Homo sapiens
gacaaatgagtgagtattggcttcaacttaaagtcaccagctgcatttgcccctaataagagagttagcctgtcctttgaagcgttgaagccagatactgacttcttatctctagctatgaaaaccctaggtggcatttttttcaatagaaggccgtttcatctacattgagaatctgtggtttggggtagataccttcatcagttatcttctggataagttgctgtagcttctacaactacttcaccttgcattttaggttaaatgcttcaccttgcattttaggttaaaaacaacgtctttccataaacttctgctagggtctatgaaccagcctttgctagtttgcacttttctttcgcagcttcctcatggtgactctcagccttaatagaattgaagagagtcttaccctggattaggct

SEQ ID NO: 337127 - DNA, 668 bp, Homo sapiens
  misc_feature (603)..(603): n is a, c, g, or t
  misc_feature (607)..(607): n is a, c, g, or t
ccaggctcaagtgatcctcccacctcagcctcccaagtagctgggactacaggtgtactccaccacacctggctaacttttgtacttttgtagagaggaggtttcaccatgtttcccaggctggtctcaaattcctgggctcaagcaatccacgtgccttggcctcccaaagtgctggcattacaggcgtgagtcactgcacctcgccacctttttctaagaagaaaaacagccttgattaagccttgattttgataacaaaaatgacagcaactccaaacaactacaatcacaattttcaatatcttttgactgattgttttagagaactaaaataaaatcttattcttattttttaaatgttttgattccagaccaagggtaaaaaacaaatacaacaaatatatagaccccacactccctctggtggaccttcactttcattaaccaaatgttttccaagaggctataagtcggcctggcactgtggctcgcacttataatcccagcactttgggaggccaaagtgttgaggtgttgacattacaggtgtgagacatcatgcctggtatatatatatactttttttttattcttaccttngttnggagtacggcttcttttttttttttttttttggaaatagagtctcgctcttttctgtcccc

SEQ ID NO: 337128 - DNA, 642 bp, Homo sapiens
ccaggctcaagtgatcctcccacctcagcctcccaagtagctgggactacaggtgtactccaccacacctggctaacttttgtacttttgtagagaggaggtttcaccatgtttcccaggctggtctcaaattcctgggctcaagcaatccacgtgccttggcctcccaaagtgctggcattacaggcgtgagtcactgcacctcgccacctttttctaagaagaaaaacagccttgattaagccttgattttgataacaaaaatgacagcaactccaaacaactacaatcacaattttcaatatcttttgactgattgttttagagaactaaaataaaatcttattcttattttttaaatgttttgattccagaccaagggtaaaaaacaaatacaacaaatatatagaccccacactccctctggtggaccttcactttcattaaccaaatgttttccaagaggctataagtcggcctggcactgtggctcgcacttataatcccagcactttgggaggccaaaggctgaggcgggtggatcacctgaggtcaggagttcgagaccagcctggccaacatggcaaaaccccgtctctactaaaaatacaaaaattagccggacatggtggcgcaggcctg

SEQ ID NO: 337129 - DNA, 452 bp, Homo sapiens
ctgcacatctggcagtggtgagtggccctcagtctccactgagggacactgagtgtctccagcatctcaataggaagcttcctgcagaccaactataatctattggcacccaagtggggagtttctatgggccagcttcaacccatgacaccctagtaaaagtcaccaacatccgaacatgtgacctcctgcagaccagctctggcccacaggacccagtgaagttctctgctcttcagcaggtagcagttgtgccctctccagtggggtcaaaaatctcagccattggtatgagctggtgcttttcaaacttttagctccttctctgggtattcttttttaccttaggagtataactgcccccaacatttgctgtgagtactttttagtctacttagtagtcaatcacattttaccagttaagaactttttctataaagttttccccattc

SEQ ID NO: 337130 - DNA, 709 bp, Homo sapiens
aggcagcgtttcactatgttgcccaggctggtcttgaacctggcctcaagtgatgctcccacctcaacctcccaaagtgctggtattgtatgtatgagccaccctgcttcgcctctgtttccttaagatcaagaaaaatgataaacctttagctagactaatgagaaaaagagacaaaattaccaacatcggggatgagagaattgacaacaccacaatttctgtagacatttctgataagatgccaaacctaaatggctacactgatgaattctttcaaagattaaaagaagacaatatcccaatattttacaaaagcttccaggaaataggaggggataatttccagctcaatgtttgagaccaacattaccctcatgccaaaataaggcagcatcatgacaagaaaactagacaatatttgccatgaagacagatgtaaacgttctaaacgagatttttttagcagtttgaatccagtgatgggtaaaagagaacacatatgaccaagtgaggtttatctcaagaatgcaaatttgggctaacattaaaaatcaattgtaattcgccatattaaacggactaacaggaaaattatgtgatcacctcaatagatgcagaaagagcatttgataaaacccaacattcattcttgataaaaactcagcaaagtaggaataaaagagaacgaaaaggacatcaaaaaccc

SEQ ID NO: 337131 - DNA, 770 bp, Homo sapiens
caggctgtacaagaagcatggtgccagtatctgcttctggtgagggcttcagactgcttctgctcatggtggaagtgccttaatatgtatgcctcatctctccgaagtggtggaccctgtttacctgctctggagaatggctgcctgtggcagacacaggagttgctctcacactgtgcttcctgtcttccatagtaactgagttgtagctgcgatgcagctactaaccaggaatagtttctcagccccacaccttgcacctacagctaagtgtggccatgttctcatcaacgaagtgcgaatagcaacaaagtgcaccaccttcaggttgaggctttgaagaagcaggggtacccttcccttgctctctttccccttctgctggtgggatatatataacaataaggccctgggtgatagtagccaccagatgcaaaacgcctcaaacctgagtcaccacatggaagagaagaagcctctgacctggaacacctagcctggtctatagatgaacaagaaataaacttctgttatgtttgaacattacagatttggttctgttatagcaagttagcttaccctgactaaactgttgcctgtctcttggaaggtgtgccctccttccctgaaagtgactttttcatacatgtaatttatattttaatccatattctccgaagcatatccacatctattcaactgtttccatgttttccaccaacagaaacctcatataaataaatatatatgaaggtttattgcattattca

SEQ ID NO: 337132 - DNA, 583 bp, Homo sapiens
  misc_feature (548)..(548): n is a, c, g, or t
caggctgtacaagaagcatggtgccagtatctgcttctggtgagggcttcagactgcttctgctcatggtggaagtgccttaatatgtatgcctcatctctccgaagtggtggaccctgtttacctgctctggagaatggctgcctgtggcagacacaggagttgctctcacactgtgcttcctgtcttccatagtaactgagttgtagctgcgatgcagctactaaccaggaatagtttctcagccccacaccttgcacctacagctaagtgtggccatgttctcatcaacgaagtgcgaatagcaacaaagtgcaccaccttcaggttgaggctttgaagaagcaggggtacccttcccttgctctctttccccttctgctggtgggatatatataacaataaggccctgggtgatagtagccaccagatgcaaaacgcctcaaacctgagtcaccacatggaagagaagaagcctctgacctggaacacctagcctggtctatagatgaacaagaaataaatcgagatgcgagaagacgtattanttcaaattcataatcaaaaaccgggatcacgggag

SEQ ID NO: 337133 - DNA, 740 bp, Homo sapiens
ggctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgggaagcagtggataaataaggctgttggagatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337134 - DNA, 531 bp, Homo sapiens
ccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcc

SEQ ID NO: 337135 - DNA, 1404 bp, Homo sapiens
ggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaaactataggccaggtgacgatctggctaacctagtccccaggacctgggctaactacatcctgcccgatgcattcgcgcggagtatgaacaagacgcatggcctgcgaactgctatccatatttccctgaagagctggaatgcgacatgtgtaaacgaaagagattccgtccagcatctcgtagattggagaaaaggcccaaggccctcatgattagaggcgaactatccagcaagtaggatctgtatcgacagaactacttcggacaaagtcgagcagctcatcgcaattgggatcgagcgattacagagactcgaatttctgcaaggaagtgccagaagtatatccgaggcaaggtttgactaaggcccataatctcacttagaggtaaattctgttgaaatccggagcaggagtcagggcaaatttgccgattacgcatgcccaggggaagagcacacgcgaggccagaattcgatctgatcgaaagaacgatcgtacgtttggattagccggggaccattcgaagaaccccaatgtagtcaaacaacgagaacttttgttcggaaaagcatgtgaagacttatggaaaatcctcgccagagaactacgcgctaaagcgttcgcatcacttggagaacactacgtagctgcgacggcaagagcgacctttcattctctcacaccggaagttctattctaagaaaaccaattggaaattcggggcgattcttccgccgaattggtcgcgggcgagggggcactttttaccagggccactcctttatccttcagatggtaagatacaagaaatttctctccgataatatgagaatcggcgttgggtggcacaatagcttactggaattccgtagggagagccacttcttggattccttcgggttgacttgggcgtgctccaaatgccgttggtagcttgagctcccgag

SEQ ID NO: 337136 - DNA, 166 bp, Homo sapiens
gtgggattgaaaacccaaatcctcatcttggagtttctccttcagccagggcagcacttgaaaccctggctgaaggagaaactccaagatgaggatttgggttttctataaggggtttcctgctggacaggggcgtgggattgaattaaaacagctgcgaacaaca

SEQ ID NO: 337137 - DNA, 2893 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337138 - DNA, 2840 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337139 - DNA, 2832 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337140 - DNA, 3108 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337141 - DNA, 1121 bp, Homo sapiens
tagaggactccccacacaagtgaaacaaggaggatatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337142 - DNA, 1170 bp, Homo sapiens
gaataatttgggaggcgaattgaagtccgggccaggaacaatggtaattgtgggagactcaacaaagagtgagtacagctgaaggagccggggagcagaaagtatgtgtcaggtgtgaggaagaaaatagatttgggaagttatgagaactgtagagagtgagttgagcatagttggtgattttgagggcctctaaaagtattaaagcagcggtagccgttgcacgcagacgtgagggctaggctaaaacagtagggtcaagttgttggcacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337143 - DNA, 2935 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
  misc_feature (2898)..(2898): n is a, c, g, or t
  misc_feature (2901)..(2901): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaacaacacnccncaacaaaaccttgcagcccccttcggaccccgaa

SEQ ID NO: 337144 - DNA, 3155 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
  misc_feature (3079)..(3079): n is a, c, g, or t
  misc_feature (3090)..(3090): n is a, c, g, or t
  misc_feature (3130)..(3130): n is a, c, g, or t
  misc_feature (3135)..(3135): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaacaaaaaaaaaaaaaaaaactcgagttttttttttttttttttgggtttaacagtttattaggatttataagtgtcattttaaaaacagtcgatttaaaccatgtagaaataagtatgcaaaaagtctgcaaaaccatactttaaacatgtttaagtagatagattatctgaaattctgatttctcagncacttcattgntatgctatggcagccaagtatccttaacttcagttggagngcctncttccacttcatttgagttc

SEQ ID NO: 337145 - DNA, 3092 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337146 - DNA, 3165 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgtctataaggggtttcctgctggacaggggcgtgggattgaattaaaacagctgcgaacaacaaaaaaaaaaaaaaaaactcgagttttttttttttttttgtgtggctcaataaacttttattgttttgttatttatttttattcaaaagaatttgtttccctatcacaaaaattagataacaccaccaagagcagcaatgtccatggagttacattgatggtggagagttggctgggtattcccaatgtcccaaaggtcataaaggagggaaaagaaaaaaagaaaaaaatattcaaaacaaatccaaaacccatgatgactttggggagagacatcacatgacattttctgtttcttctctcattgtcagctg

SEQ ID NO: 337147 - DNA, 3163 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacacaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337148 - DNA, 3188 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337149 - DNA, 2986 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgagcgtacaagcaccgatgtcaggtagtcggttttctgttaggcgaaatgtgttggacatgtgcgaaggactggcattaaccgagcgcagacgccaaaagg

SEQ ID NO: 337150 - DNA, 1997 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcc

SEQ ID NO: 337151 - DNA, 1565 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggatccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337152 - DNA, 262 bp, Homo sapiens
gtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctg

SEQ ID NO: 337153 - DNA, 520 bp, Homo sapiens
cttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattct

SEQ ID NO: 337154 - DNA, 911 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggacta

SEQ ID NO: 337155 - DNA, 704 bp, Homo sapiens
tttgcaaaggggttttctttggtcttttttaaagggcgagaaagaagaaaaaaagggtaattttttcttccaccgtgtaaaaacccacaccttaaaaaaaaaaaaaaaagctctagaacggggtttcctctcggtccggattcggggccaagcaccaaggaaccacccgaagtttagagcttccttccaacaaccccttgcaaccaccaaaagaaaaactgcttcctgccccagaaaacaaaagccctgttggtgtttaagaagaagaaaaagttgactcgaaagaaggtttcatccaagaatggggataaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337156 - DNA, 2830 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337157 - DNA, 2599 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337158 - DNA, 2860 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337159 - DNA, 1020 bp, Homo sapiens
tactcaagcaaacatggcaggccaagatctcagtcattcgcccttcaaagggacacgagagctgtatgggggctgtagatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaaca

SEQ ID NO: 337160 - DNA, 3102 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
  misc_feature (3026)..(3026): n is a, c, g, or t
  misc_feature (3037)..(3037): n is a, c, g, or t
  misc_feature (3077)..(3077): n is a, c, g, or t
  misc_feature (3082)..(3082): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaacaaaaaaaaaaaaaaaaactcgagttttttttttttttttttgggtttaacagtttattaggatttataagtgtcattttaaaaacagtcgatttaaaccatgtagaaataagtatgcaaaaagtctgcctcagncacttcattgntatgctatggcagccaagtatccttaacttcagttggagngcctncttccacttcatttgagttc

SEQ ID NO: 337161 - DNA, 2950 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgaacaacaaagaaaaagagatcataaaacacgaaaagagcaacaaacacagacgaacacaggggg

SEQ ID NO: 337162 - DNA, 4981 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagagttctggcggccccttgatagttcacaagattcctgagagtagcatcacataaagagatgtggacaatttggataagcaaaatgtggcatatgcttacagtggaatattaatcagccttaaaaaggaaggagattctaatacatgcttcaatttgcttcaagcaaattgtaaaaatgtaatttggttaagataaagatataggtgtaaattctgctccttagctataaaagcaccttgaggacattatgcaaaatgaaataagcccatcacaaaaagacaaaacaccagatgatttcacttatatgaggttcttagagtaagtcagattcatagagacagaaagtagagcggtgattgcccccacctgaggagaggtgggaatggggagttgtttaatgtgattcagtactacaggagattggttgcccagcagtgtgagtggacttaatgctgcagaactgtacgtttaaaatggttaagacactaaattttatgtgtactttaccgcaatttaaaaaaattttaaagggattcagacaacttggaatactattttaatagtagaattttacatgaaacctttcttttgatggttgagaatggagagaatgctgatgtgaaacctagaatacttaaaaaatgtaaatagagaattatgaattattgataattcatgagtgaattatcatataatatgagttatcacatttgagttcataattttcagttactgcttttctattttatgctttatttattaaaatgccttttagatctggcctttctcgtctcacctgttgtatgggctgtaacacatctggcaaatggatggattgatttttagatgaaggtctgctttaatcgagtgagagtgtgaagtgtcaactctacagactttgacaaaagcacagctggggaagcagaacaattgtgtttattaaaaattacctgtatcagctgggcatggtagctcatacctgtaatcctagccctttgggaggatgagatgggaggattgcttaaggacagcttaaagaccagcctgggcaacatagcaagatcccatctctaacaacaacaacaacaaaaatcaaaaaattaggcatggtggctcatgcctgtaaacctagctactcaggaggctgaggtgggaggattgcttgtgctaaggagtttgaggcagtgatgagccgtgattatgccatggcaacagagcaagaccctgggcaacagagcaaagaaaatatctatatgtattttttaaaaataattcaaactcagccaggccagatgcctcatgcctataatcccagccctttggaatgctgagatgggcagatcacttgggctcaggagttcaagagcagcctggacaacatggcgaaaccctgtctctacaaaaattacaaaagttagccgggtgtgttggtgtgcccctgtagtcccagctgtggcggcaggctgaggtgggaggattacttgagctgaggaagtcgaggctgcagtgagctgagattgtaccactgcactctggccgagggtgactgagtgagaccctgtctcaaataataataataataataataataataataataataatcatccaaactctaagatttctatagtttttttaaatttgtaattatttcattaaagtttaggagattttagcaatgacttagctttctttaaatttgaaaacatagaaaggtttctcagtgtctccaataaaattcagtatttccatttaaaggctcctgtatgcagaaatttggaactcagcactgaaagcctgctttcacctcacacattaaagcactgtgtcatctcaggattttattttaaataacatgaagctaagtttaacatcaccttatacttatatgacctttgttgtgttagaacgctttcatgtttcataatagcagtaatatttgaaaattgttttctttctataccttcatgttataaccataattaaaagtctcattatcatctatgtttctaacaatgtgttatattattgagtacttatcttcatgtaatagtataattttttgtgatagtataaggtgctaataattgaaacaaattgccctcagcatacttagatgttaggaaagtgaaatactattttttccatgtctgttacctaaatgcaaaacagattttctgtttgagttgcccatatcatgtgcatttaggattagtcctgtataatttatagtggtgttagcggaaataaagcataaaatgtataaatcctgtattttaattgccagatgtagaaatccttaacattttcctcgtagttcttttttttttttttgacactttatgcttttt

SEQ ID NO: 337163 - DNA, 2835 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcgccctggctgaaggagaaactccaagatgaggatttgggttttctataaggggtttcctgctggacaggggcgtgggattgaattaaaacagctgcgaacaaca

SEQ ID NO: 337164 - DNA, 4937 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaggcagctgtgagagagatgctcaatatgccccaggctatgacaaagtcaaggacatctcagaggtggtcacccctcggttcctttgtactggaggagtgagtccctatgctgaccccaatacttgcagagttctggcggccccttgatagttcacaagattcctgagagtagcatcacataaagagatgtggacaatttggataagcaaaatgtggcatatgcttacagtggaatattaatcagccttaaaaaggaaggagattctaatacatgcttcaatttgcttcaagcaaattgtaaaaatgtaatttggttaagataaagatataggtgtaaattctgctccttagctataaaagcaccttgaggacattatgcaaaatgaaataagcccatcacaaaaagacaaaacaccagatgatttcacttatatgaggttcttagagtaagtcagattcatagagacagaaagtagagcggtgattgcccccacctgaggagaggtgggaatggggagttgtttaatgtgattcagtactacaggagattggttgcccagcagtgtgagtggacttaatgctgcagaactgtacgtttaaaatggttaagacactaaattttatgtgtactttaccgcaatttaaaaaaattttaaagggattcagacaacttggaatactattttaatagtagaattttacatgaaacctttcttttgatggttgagaatggagagaatgctgatgtgaaacctagaatacttaaaaaatgtaaatagagaattatgaattattgataattcatgagtgaattatcatataatatgagttatcacatttgagttcataattttcagttactgcttttctattttatgctttatttattaaaatgccttttagatctggcctttctcgtctcacctgttgtatgggctgtaacacatctggcaaatggatggattgatttttagatgaaggtctgctttaatcgagtgagagtgtgaagtgtcaactctacagactttgacaaaagcacagctggggaagcagaacaattgtgtttattaaaaattacctgtatcagctgggcatggtagctcatacctgtaatcctagccctttgggaggatgagatgggaggattgcttaaggacagcttaaagaccagcctgggcaacatagcaagatcccatctctaacaacaacaacaacaaaaatcaaaaaattaggcatggtggctcatgcctgtaaacctagctactcaggaggctgaggtgggaggattgcttgtgctaaggagtttgaggcagtgatgagccgtgattatgccatggcaacagagcaagaccctgggcaacagagcaaagaaaatatctatatgtattttttaaaaataattcaaactcagccaggccagatgcctcatgcctataatcccagccctttggaatgctgagatgggcagatcacttgggctcaggagttcaagagcagcctggacaacatggcgaaaccctgtctctacaaaaattacaaaagttagccgggtgtgttggtgtgcccctgtagtcccagctgtggcggcaggctgaggtgggaggattacttgagctgaggaagtcgaggctgcagtgagctgagattgtaccactgcactctggccgagggtgactgagtgagaccctgtctcaaataataataataataataataataataataataataatcatccaaactctaagatttctatagtttttttaaatttgtaattatttcattaaagtttaggagattttagcaatgacttagctttctttaaatttgaaaacatagaaaggtttctcagtgtctccaataaaattcagtatttccatttaaaggctcctgtatgcagaaatttggaactcagcactgaaagcctgctttcacctcacacattaaagcactgtgtcatctcaggattttattttaaataacatgaagctaagtttaacatcaccttatacttatatgacctttgttgtgttagaacgctttcatgtttcataatagcagtaatatttgaaaattgttttctttctataccttcatgttataaccataattaaaagtctcattatcatctatgtttctaacaatgtgttatattattgagtacttatcttcatgtaatagtataattttttgtgatagtataaggtgctaataattgaaacaaattgccctcagcatacttagatgttaggaaagtgaaatactattttttccatgtctgttacctaaatgcaaaacagattttctgtttgagttgcccatatcatgtgcatttaggattagtcctgtataatttatagtggtgttagcggaaataaagcataaaatgtataaatcctgtattttaattgccagatgtagaaatccttaacattttcctcgtagttcttttttttttttttgacactttatgcttttt

SEQ ID NO: 337165 - DNA, 2559 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
  misc_feature (2329)..(2329): n is a, c, g, or t
  misc_feature (2468)..(2468): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagccgggcctttggtgaaccaagtgaacatcaatgctttggcttncaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattancacaagcaaccatggcaggccaagatctcagtcaattcgcccttcaaagggacacgagagctgtttgggggcttgggtgtttgagtacttt

SEQ ID NO: 337166 - DNA, 1539 bp, Homo sapiens
  misc_feature (171)..(171): n is a, c, g, or t
  misc_feature (173)..(173): n is a, c, g, or t
  misc_feature (325)..(325): n is a, c, g, or t
  misc_feature (363)..(363): n is a, c, g, or t
  misc_feature (387)..(387): n is a, c, g, or t
ggaccaaaggcaagctcttccttggcaaacaatcggctgagttccagacccagggatcactaatgcagaagcaagcatccaaactctgtttgcaaaggcttgtctagattacactgagagcattttaaagagtcattgccggctcgttcggcaagataggtactgacgggnanctggtctcaagggggttggtttgcagcttcacaagtagaggatgccaagctgccaagagcccatgaagacggtgaattgatgaaataagttaccttggactgggcaaaactaagggtgaaggtggcttcgggggtcgtggtgaaggcagagncgctttgaaggacgaggtggtggtagagaaggccgagnaggatttggtggcagaggccgggnaggctttggagggcgaggaagcttccgaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaaccagggccccgg

SEQ ID NO: 337167 - DNA, 194 bp, Homo sapiens
cgggctttgggaggccacggcaagaggatctcttgaggccaagagtttgagacaatagagcaacatagataggcaatatagcaagactgccgtctctacaagaaaatttttaaaaattgccaggcatggtggtgcatctgtggtcccaactactcaggaggctgaggcaggaggatctctcgagcctgggattt

SEQ ID NO: 337168 - DNA, 303 bp, Homo sapiens
ttcagaaccacctgacagacacaggggtcatatggggctaggtcgaaagatcagcttgattaataatggattggtggatgtagcctgggtatacagcttcctagtactagactcctacatcagagacatccattctccaaccattcacgagaagaactggccagacaccgtaggctttctcattagggcaggagctcagcacatggcatgtccacactgaaagaatgagaggaaaaaatgaatggaaaatacaggtggtattgaagaaagagcactcttcctgtggggggtcagatccaaaat

SEQ ID NO: 337169 - DNA, 371 bp, Homo sapiens
ccaggaggcagaggttgcagtgagccgagatcgcaccactgcactccagcctagtcgacaaagcgagactcagtctcaaaaattaataaacacacacaaagttagtcatatttatttcatttgtatacatgggaaaatttggagagacaatttagaaagaactaccattttaggctgggtgcagtggctcacgcctgtaatcccagtactttaggaggccaaggcgggcggatcacgaggtcaggagatcgagaccatcctggccaacatggtgaaaccccgtctctactaaaaatacaaaaaattagccaggcatgatggcgggcgcctgtagtcccagctactcaggaggctgaggcaggagaaccgcg

SEQ ID NO: 337170 - DNA, 805 bp, Homo sapiens
cagaggatccccaaagccatgtctctaaagccatctctgctaaaaatatgaaaattagctgggattacaggtgtgcgccactaccacccggctaatttctttatttttagtagaaacggggtttcaccatattggccaggctggtctctaactcctgacctcaaatgattcacctgcctcagcctcgaaaactgctgggattacaggcgtgagccaccacgtctgacctatccattcatatgttgatggacgtttggattatttccaaggtatgctacttttttatagctcttaaaatttttccaaattcctctccagaaatgtactttatcatcacctgtggtacatcagggtattttccactttagacattcttgatctattgtctgagtacttgaagtggtgtgactgtaggctgactgttgaatgaagctgaaaggggggttttaatagcaggtcacaaacttggatagaagaggagatgtctctcgggctggttggatatataataagttctggaaggccacatgctggtgatgatgtcatccagaaagggtttggtactgaatttctgttcaggaacgttccttgtcagggatgttagggatctgccttgtcaactgtagtccttcgtcagcctcttcagaagttgatgcccacttagctcttgaagcaggtgttctaagtaaataatattttgtactcttatattctgtggattagttgtaggtacatgctgttgtgaaaataaattcatttgacttctctgtatcttgattgtggaggtgatcacacaactgttatt

SEQ ID NO: 337171 - DNA, 365 bp, Homo sapiens
gagtggggaacagacttgggtggaaaatgtaaagaaatagcatgttgagaagaaattaaaaagttaaagtgccctaccaataaatcactaaagaatttcactggctgggtgcagtggctcacacctgtaatcccagcactttgggaggccaaggtggatatcacttgagctcaggagtttgagaccaacctggccatcatggccaaaccctgtctctactaaaaatacaaaattagccgagcttggtggtgtgcacctctcgtctcagctactcaggaggctaaggcaggagaatcacttgaacccaggaggcagaggttacagtgagccgagattgctccattgcactccagccttggcaacaa

SEQ ID NO: 337172 - DNA, 524 bp, Homo sapiens
ggacatggttctggtttcaaattctagacttccctgttctaccactgggctacctgtagaacttgggtaagtgacctaacctttgtgagtcttaattacagtagttacctcatacagtggttgacaggtttaaatgtacaaaaaacagtgtagagttctctacataatgtaatcactctgacagccaagccattctctttactctactcatcattatcaatttctgtgattactattacattatggttattactggtatttgttgttattgtgtagtccttcctttttctctgtctcttcattctatattccttctttccttttacctctacctcttcttcctcccatctttcttcctcttactccttcacaccctcctgtgctgggccttgtattgggagatctctctgaaggtgaaccacattctcaagtcagaaaggaagacccttagatttccatccatctctgtaggaagccaatcacaggaaaattgcttagaccccaatctttcctgcaaaaacaag

SEQ ID NO: 337173 - DNA, 471 bp, Homo sapiens
tagagaacagaaaagaaagaacaaaacacagctgttttccatgttcttagaacaattactgccaaagtttcctcgaattgcaagaggctgaggtcctatgcagtgaaggcttaagcaaacaaaggttagggatttctcttagttaatgagatggcagatgtcagctcaattgtgtgcatacgttaggctgatctgatcgctgggcggtacatccacaaagctcaaaatcggtgccacagtgtctccttaatttcctccgaggaagaaaactagtccatttagactaattcccatataaaatttacacaacaatcaatacaaataatgccttaacctagaaacaaaagcaataaaatctagaactggaaagaactacctttctttatcccttaaaaaaaaattccgctttagaatgtgtggaaaaaggcaataaaatttttttttaaagaaaaagaaggccgggtgcagtgg

SEQ ID NO: 337174 - DNA, 308 bp, Homo sapiens
catggggcatcttcccccgagtgcaggcctggctccacttcttcctgccggtgaccctggacaaggattttaccgtttgtcctgtcttcctagctttttgagaaccactggcagaggtgggtgtgaaagcgatagtaaaacatccataagggactgaggagcttactgtgaattggacttgaaaaggaaacctcagaaattatccacacacagggatttatacacaaacctacaggatacacacgtgccgaggcttaaaggaggctgtactttttacaccctctgcagagtcggacgtgaccaacccg

SEQ ID NO: 337175 - DNA, 444 bp, Homo sapiens
cctattgcccaaattgtttggattaactccactagtagatatatttccacagcagtgaattttcagtcaatagaattacagaggaacctaataaggaagtaagtaatgtgggaagatcgagataagacagggtaggtatttcacttgaccagtgaaacatgaaaatgctcttgggaagccagggcaattctgaattacgttaatggaagactctattcaatgtacttgactactcttcttgcccattttattctctgacttatgaggattaattataactctactaacctgtattttcttgtttagcctattccaggtccttaattctggactaggcatataatttcacaatatacaccaaaaaggctttaatgaagtataaagggatgtaaaaaattcttctaaatcttccctttccctgtaggatatttgtttaaaaatcat

SEQ ID NO: 337176 - DNA, 316 bp, Homo sapiens
cggtaccccctagttttagaagtttcaatagcaagaaaaaattagccaggcatggtggcacgtgcctgtaatcgtagatagtcgggaatctgaggcacgagggtcgcttgagccctagttttagaagtttcaataccagagatttcctgcagagacttgacttgcagattaagttatcaacacaggcagccaagaagctaaaagaagagagcagagatgaagaaagtccatcttaaaatcataactaggtagtttaggtgttggcctcagcctaaccctctaggacgaaagccttgtctgtggggaattttggatg

SEQ ID NO: 337177 - DNA, 2132 bp, Homo sapiens
gcaatacggggcagggagatgcgatttcagggtgtcaaagaataaactgacgaagagaagatgaatgcagacagtaaattccaactactgagcctggagaatgaattgtatgtggccagcctttcgaggcagccaggacttaaattggcactagtgtacaaagtgtgaaacccgaacaactaggggggttattttgaggccacccattaggccttagaagcactatccctcctagtgcaatgttgaaaggactggactctgaggctgttgagatggacctggagaagctgtctgtgtgtgtttgatgatcttaagttttactgtgacgtggactttgaggtcactggggtggggggagggaagtacccttggcattggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcaggtgcgtgtgccgcgggacgcccggggcaggcaggacgcagaggaggaggcgcccgccatgcccggcctgcggctccccgcctcggcttcccgtccgccgcccccgcggaacggcctgctgcagcccctgtgaagaggaagaggcggcggcggcggcggaggaggaggaggcgccgcccccttggcaagctccccgacccggcggcctcggcaggacccatggcggattcctcgcccgcactgtccctgcgggaaggcggcccccgcgcgccgcggccctcggccccctcgccgccgccgcgctcgcgctccggctccgagtccgaggaggccgagctgtcgctgagcctggcccgcaccaagacccgctcgtacggcagcaccgccagcgtgcgggcgccgctgggcgccggcgtcatcgagcgccatgtggagcaccgggtccgcgcgggcgacacgctgcagggcatcgcgctcaagtacggtgtcacgatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaacttgagtctcctttttttttttaacaaatgagaaaataaaattgacttttaaattatacatttaaatgctga

SEQ ID NO: 337178 - DNA, 1304 bp, Homo sapiens
agcgggccgggcgcggcgccggggcgcgcggctgcagcggagcaggctgggaagcgtagttcccggctgagcctcgccgcggccccgcagtcccccagccccgcccttccccgacaggtgtcctctcccggaatcggggtctgaaccccgccacagctctgcaggggaggaagcacctgggtcggggagaagcctgggcaggctctttggagacgctcggggctccggagagcgtggatggcaaaggctttcaagcctgtgatgagcattcctgtgagcgagcatcctgacacggaagccgcgttgagagcggtctcagatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaacttgagtctcctttttttttttaacaaatgagaaaataaaattgacttttaaattatacatttaaatgctga

SEQ ID NO: 337179 - DNA, 1046 bp, Homo sapiens
  misc_feature (31)..(31): n is a, c, g, or t
atgaatttatattagattatataaaaacaanaaactccccccccaacctactaggcacagcatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaacttgagtctcctttttttttttaacaaatgagaaaataaaattgacttttaaattatacatttaaatgctga

SEQ ID NO: 337180 - DNA, 2468 bp, Homo sapiens
gcaatacggggcagggagatgcgatttcagggtgtcaaagaataaactgacgaagagaagatgaatgcagacagtaaattccaactactgagcctggagaatgaattgtatgtggccagcctttcgaggcagccaggacttaaattggcactagtgtacaaagtgtgaaacccgaacaactaggggggttattttgaggccacccattaggccttagaagcactatccctcctagtgcaatgttgaaaggactggactctgaggctgttgagatggacctggagaagctgtctgtgtgtgtttgatgatcttaagttttactgtgacgtggactttgaggtcactggggtggggggagggaagtacccttggcattggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcaggtgcgtgtgccgcgggacgcccggggcaggcaggacgcagaggaggaggcgcccgccatgcccggcctgcggctccccgcctcggcttcccgtccgccgcccccgcggaacggcctgctgcagcccctgtgaagaggaagaggcggcggcggcggcggaggaggaggaggcgccgcccccttggcaagctccccgacccggcggcctcggcaggacccatggcggattcctcgcccgcactgtccctgcgggaaggcggcccccgcgcgccgcggccctcggccccctcgccgccgccgcgctcgcgctccggctccgagtccgaggaggccgagctgtcgctgagcctggcccgcaccaagacccgctcgtacggcagcaccgccagcgtgcgggcgccgctgggcgccggcgtcatcgagcgccatgtggagcaccgggtccgcgcgggcgacacgctgcagggcatcgcgctcaagtacggtgtcacgatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaaaaaaaaaaaaaaaaaaaaaaaaacaaaaaaaaaaaacacaaacaacaaaaaaaagcaacgaaaaaacacaaaaaaaaaaaaaagaagaggaacaacacgggggcgggggccgccatgacagacgcggggcccacaccgcggacaataaaaatacatatatatcagaaaaaagacgtcataaataataatcagaggtgctgcttataagaagatttaagatagagagtagagtatattataagggctatagttatggaatttaatatggtgaaaatatatttcaaagaaacaaaactcaggatgagtagtacaagaataatctcacaacgttgtcaagatttatacgagatagagctagaataaatctaaggttgtatagtgtttacaatctagttaataaagtatatg

SEQ ID NO: 337181 - DNA, 2205 bp, Homo sapiens
gcaatacggggcagggagatgcgatttcagggtgtcaaagaataaactgacgaagagaagatgaatgcagacagtaaattccaactactgagcctggagaatgaattgtatgtggccagcctttcgaggcagccaggacttaaattggcactagtgtacaaagtgtgaaacccgaacaactaggggggttattttgaggccacccattaggccttagaagcactatccctcctagtgcaatgttgaaaggactggactctgaggctgttgagatggacctggagaagctgtctgtgtgtgtttgatgatcttaagttttactgtgacgtggactttgaggtcactggggtggggggagggaagtacccttggcattggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcaggtgcgtgtgccgcgggacgcccggggcaggcaggacgcagaggaggaggcgcccgccatgcccggcctgcggctccccgcctcggcttcccgtccgccgcccccgcggaacggcctgctgcagcccctgtgaagaggaagaggcggcggcggcggcggaggaggaggaggcgccgcccccttggcaagctccccgacccggcggcctcggcaggacccatggcggattcctcgcccgcactgtccctgcgggaaggcggcccccgcgcgccgcggccctcggccccctcgccgccgccgcgctcgcgctccggctccgagtccgaggaggccgagctgtcgctgagcctggcccgcaccaagacccgctcgtacggcagcaccgccagcgtgcgggcgccgctgggcgccggcgtcatcgagcgccatgtggagcaccgggtccgcgcgggcgacacgctgcaggggacattcggcggcttcaaggtccggggtggtcacggattgggaaccaggaatttagagggggggccaattaaacctgttttacccacagttgactgggtactattttcctgaaacgaaaactcttttgtggaaccattccccaggtttatattccaggaggaaagcctttgtgtggtttacacgtgggacttaacgctccatgtgatttcttccgagagagaagtggacaacggggtgtgattacagcagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaacttgagtctcctttttttttttaacaaatgagaaaataaaattgacttttaaattatacatttaaatgctga

SEQ ID NO: 337182 - DNA, 495 bp, Homo sapiens
tagtgttgtaatagatttatttgcttccattgttctgatagcattctggatggatggtgagaatatgaaatccatttcctcccaaagcattcaatggtgttttggtgtttagaaagaaaaagctgcaagttttgtggtcttcctctccaacataccaacttccctccccacttaacacccatgggagtgggcaggagtggtgtctcagtccaatttctggcattatgacagaataccaaagacgggataatttataaagaaagatttatttggatcacagttctggaggctgggaagtccaggagcatggcactggcatctggtgaagtcatcccatggtggaaggcatcacatggcaagcaagcatgcaagacagaggaaaaaggggccaaacacgcaaaagctaacccactctcaaggtaatggcattaattttttcatgagggtgaagcccttatgacccaatcacctccaaaaggcctcacctcttcacat

SEQ ID NO: 337183 - DNA, 360 bp, Homo sapiens
ctgggcgcggtggctcacgcctgtaatcctagcactttgggaggccaaagtggacggattgcctgagctcaagagttcaagaccactctgggcaacgtagcaaaaccccatctctactaaaaatacaaaaaaaaattagctgggcgtggtggtgtgcagctgtagtcccagctactcaggaggctgaggcactagaattacttgaacctgggaggtggaggttgcagtgagctgagatcgcgccactgccctccagcctaggcgacacagtgagactgtctctaaaacaaaaacaaaacaacagaaaaaacagactttcctattcactgaaatatctcattgaatatcagtccccaacgt

SEQ ID NO: 337184 - DNA, 468 bp, Homo sapiens
aggccgtttaggcgtgtctttgatgctgacacttccacacccagcactctggtgccccttactaactggtttatctctgcacactgccctcccaggaacctaattaagttgtaggcctgtgtgaggccagctgctgctggaccatcagcatctctcttccaggacccctaggtctctccaaatggcacagagttccctggggcagaaagacgggctaatcccattgttgggaagtcaggtgcggagtgtctgtgttgaatgattacaagcatgaagatgatttttgaatctcacagagggatgctctgcatatttcctctctgctttcagccatttcctaggttatacacagtttggctctgctccaaaaagagaaaacataagtaataggacagtaggcctgttttcaatttgtaatgcatttttttctgccacccgtcacaattagatttcactcatcgcctcctg

SEQ ID NO: 337185 - DNA, 331 bp, Homo sapiens
ctccctaagaggttgtaatttatactccaagcgagcaatgtgcctccttctacatacgtaatactcaacttatatagccaaagtaagccaactgtatggtgggggagataacagaaaaaaaaagtgttcatttttatgtaagagaagtaggatttttctcatgatttaatgtcatattaaacatttaaaattaaaatattatttctacaaagtttcagcaaatgagttaagtaaacaaagctaagtgattaggaaaactcctagttattaaaagactgtggaaaaattagtgtatttaaaaagccatgtatttctctggaggttatggcat

SEQ ID NO: 337186 - DNA, 123 bp, Homo sapiens
ctgacctattgcatcagtctgatgcgggaagtgctgtaattttcattttacatgaagctgaggccagggaggaagttgtcatttgtgtaaggtgatggaacttaatgaatgactcctagggtt

SEQ ID NO: 337187 - DNA, 165 bp, Homo sapiens
ggaccaggcaattatattagggaaaacagataagtttgtgggttgccaaataaagaagcaatcacagagataaaagcaggcactttccccaaacggaaagcataactaaatcattcatcagcttcccatgcagagctcaggcacctgatctggagacaaataagg

SEQ ID NO: 337188 - DNA, 303 bp, Homo sapiens
gaaatcagaaatttggatgactagaagtcctttaacatttgagagggattcttatccatcattcagctggcggagtgaccatcaattggtggacgtaaatggaaggagcagtgggaatgtgcttcactgctgcagggatctgatgcaaaggaggttttggggatgcacccgtgttctcatgaccgagggggctcctagcaccgagtcatgaggcctctcactcccagcagaaaagcttttcgccctaatggacagtgccaggactcacagcatggccattgttctgaaactccagctctgcca

SEQ ID NO: 337189 - DNA, 301 bp, Homo sapiens
ctcttcaagcagtccctgcccccgatgtattacagacgaagtagttcctctccctttcagacacagctctggagccaggattctgggaataaggccacttaaacacgccctgtttcccctctgctcccaactgtgacctgctactactgcctgagtcaagcagaggctggggcagtgggtgggtgggacctggctgccacaggtgagaggctatgtctgaggtggaggctcccaggggaaccctggggcaggctggcccatcatgggaccccagggagaaggcagtgtggcttttgtatcc

SEQ ID NO: 337190 - DNA, 389 bp, Homo sapiens
ctgttttttctttaaaactaacattataatgactcaaatgaggaacagggatttgaatgctcagcaatctcttctgtgtaaaaacaaagactgatgctcagcagcacatgcttaagaatttaaattaatgacactttcagtctcctagtatttaaaaacagcagagaaagccaaggagaggaacgacttcaaacatcagaatcccctcccatccactggaattctttcctttcaggtctgttgttcattgtcaagctaactgaaggagcagagacgggacagggtggctttaaggtggagagcacagcttaccacccaggttttccaacaaccagttccaaagtgacaattcccaatcctcagtttttctggtgctatccattctacgg

SEQ ID NO: 337191 - DNA, 460 bp, Homo sapiens
cggactgagagttgatgcggcctattggctgggagctcagctggacagttggtcagagagtctatgtatctcttctcctgcatggtggtctcagagtagtataacattttacatggtggctgacttcccccaaggaaggtaactcatgagaaccaaggatagtatggcctttactgacctagcttggaatttcatagccctacttctgcttaattctattagtaaaaagcacatcactggccgggtgcagtggctcacacctgtaatcccagcactttgggaggccaaggtgggctgatcatctgaggtcaggcgttcgagaccagcctgaccaacatggagaaaccccgtctcttctaaaaatacaaaattagctgggtatggtggcgcatgcctgtaatcccagctacttgggaggctgaggcaggagaatcactcgaacccttggggtggaggttgc

SEQ ID NO: 337192 - DNA, 6254 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacattgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaa

SEQ ID NO: 337193 - DNA, 8803 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaaggcagccgcgaggggagtagggcgccagcgcgcccgctcgcgcagcgcctcgggccgcttgggccgccaccgcgtccatgaccgcgacccctcggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctactcctgtccttcctctttttcgcattataaccccctactttcttcctctcaccttgtaagctttttttctaggccccccattttttttcttaaaaaaaaaagggaaacaaaaaccctattgctacaaatgagaattttgagggtaactcttcgctagagccagagaccttttaaaggaatgcatcggtgtgcaggaatcgtggtggtgaggagactgaggtcctcagtatctgggaaatcttattgaggggaccctgtttcggtcatgtcacttgtgtcttcagtttggagatcctgaggttgtctgaagcgagtggatctatttttctaagtccaatagacgaccgcagtgagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgaggtactacacccggaaagcttcgaccctcgctgttttattttgtgctgggggcgatttctatgttggtgactgtttagatgtatttaatgaattttcctttttaagtgaatttttctttcaccccagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacattgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaataaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcaggaaaaaaaaaa

SEQ ID NO: 337194 - DNA, 7940 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaaggcagccgcgaggggagtagggcgccagcgcgcccgctcgcgcagcgcctcgggccgcttgggccgccaccgcgtccatgaccgcgacccctcggcgggggacacccgcccccgctctccgcagccgcccgccgtccgcgcccgccgagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacattgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaataaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcaggaaaaaaaaaa

SEQ ID NO: 337195 - DNA, 8778 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaaggcagccgcgaggggagtagggcgccagcgcgcccgctcgcgcagcgcctcgggccgcttgggccgccaccgcgtccatgaccgcgacccctcggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctactcctgtccttcctctttttcgcattataaccccctactttcttcctctcaccttgtaagctttttttctaggccccccattttttttcttaaaaaaaaaagggaaacaaaaaccctattgctacaaatgagaattttgagggtaactcttcgctagagccagagaccttttaaaggaatgcatcggtgtgcaggaatcgtggtggtgaggagactgaggtcctcagtatctgggaaatcttattgaggggaccctgtttcggtcatgtcacttgtgtcttcagtttggagatcctgaggttgtctgaagcgagtggatctatttttctaagtccaatagacgaccgcagtgagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgaggtactacacccggaaagcttcgaccctcgctgttttattttgtgctgggggcgatttctatgttggtgactgtttagatgtatttaatgaattttcctttttaagtgaatttttctttcaccccagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacattgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaatagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaataaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcaggaaaaaaaaaa

SEQ ID NO: 337196 - DNA, 8863 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaaggcagccgcgaggggagtagggcgccagcgcgcccgctcgcgcagcgcctcgggccgcttgggccgccaccgcgtccatgaccgcgacccctcggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctactcctgtccttcctctttttcgcattataaccccctactttcttcctctcaccttgtaagctttttttctaggccccccattttttttcttaaaaaaaaaagggaaacaaaaaccctattgctacaaatgagaattttgagggtaactcttcgctagagccagagaccttttaaaggaatgcatcggtgtgcaggaatcgtggtggtgaggagactgaggtcctcagtatctgggaaatcttattgaggggaccctgtttcggtcatgtcacttgtgtcttcagtttggagatcctgaggttgtctgaagcgagtggatctatttttctaagtccaatagacgaccgcagtgagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgaggtactacacccggaaagcttcgaccctcgctgttttattttgtgctgggggcgatttctatgttggtgactgtttagatgtatttaatgaattttcctttttaagtgaatttttctttcaccccagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaaaaaaaattttttaaaaaaaatttgggggggtttgggggggtttaaaaaccaaaaaaaacccatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacattgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaataaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcaggaaaaaaaaaa

SEQ ID NO: 337197 - DNA, 5170 bp, Homo sapiens
gatcctagtgtaatagctcagagaaggcagcggaaccaacaattagaaagcttagcagtctcagggatccgaaaagctagctgagcaccttacctcatttccagctttaggaaataattgaatttacagtgtagtgtaacagttgattctaatgatgatcatcaggcatcaagaagaggggtgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaataaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcaggaaaaaaaaaa

SEQ ID NO: 337198 - DNA, 5239 bp, Homo sapiens
attattcatgccttcctttttttttttttttttttttttttttttttttgagacagagtctcagtctgtggcccagactggagtgcagtggcgcgatctcggctcactgcaagctccgcctcccggcttcacgccattctcctgcctcagcctcccgagtaactgggactacaggcgcccgccaccatgcccggctaattttttgtatttttagtagagacggggtttcactgtgttcgccaggatggtctcgatctcctgaccttgtgatccgcgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaataaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaaattctcttttggctctaagaagtcagctgtatgagcaggcgtgaccatatcataacatgctgatatgatagaaatcaataaatttttacctctcaggaaaaaaaaaa

SEQ ID NO: 337199 - DNA, 754 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaaggcagccgcgaggggagtagggcgccagcgcgcccgctcgcgcagcgcctcgggccgcttgggccgccaccgcgtccatgaccgcgacccctcggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctactcctgtccttcctctttttcgcattataaccccctactttcttcctctcaccttgtaagctttttttctaggccccccatttttttttttttttttttttttttttttttttttttttttttttttttttttttatttttaaattatttttttatttattaatattatttttttattatataaaataaa

SEQ ID NO: 337200 - DNA, 1072 bp, Homo sapiens
tgaaaggtatacagaattctattctatctttggcaactcctccacaaatttaaaattattttaaaataaaaagttttaaaaaaattgggaagaaaatcactcagaaagtctgttttgatataaaataaaactttctttttaaaatccttcgaagtataaagaatttcaaaaataattaacattttaatcacactgtaaacattgtgcattcagatatttttttaagctgacagactagttagatgaaaagagtccagactgaaatgtttggaatgggtgtctcaatcctagattaaaataagtactctttctaacatgtcttaagacactacttttaaggaattactccagaaaaacttcaggaaataatttttgcctggttagtagcctcaaggatttaaactgattaatatttttattaaatatttctgtagtagattacatttttttctttctttcatgagaagtgttttatcagaaaggtgtgtctaaaatggatgctttccttgtttattttctgggtgtgtttggaagtagactgttgcttatcttcatactgctcccaatatcaccttcttctgaaataatttgttttggtgtgtttggtatatttgaaaatattcccaagagccacagactggtgaaaattcttccttgaaggggttgattggtaatatatatatgtgatacttataacttcatttttcttctctccttgactctgaccaaaacctttgcactgattgattatagttgcgccaaaattgttcacaatgtctgctagataaaccataataatctagagctattcaatagcagacaggtccttactaaaaaataatttagaactagagaattattaaggtcagggaatagtataataagagcactgttctgattttccccaaaattatgatgtgccttagttcagaaaacccagccttgctaggagcggtgcctcacgcctgtaatcccagctttttgggcggctgaggccgggggactgcttgagcctaggagtttgagatagcctgggcagtatagtgagatcctatctctccaaaaaaaaaaa

SEQ ID NO: 337201 - DNA, 346 bp, Homo sapiens
taacattagaggaggctgagtgaaaggtatacagaattctattctatctttggcaactcctccacaaatttaaaattattttaaaataaaaagttttaaaaaaattgggaagaaaatcactcagaaagtctgttttgatataaaataaaactttctttttaaaatccttcgaagtataaagaatttcaaaaataattaacattttaatcacactgtaaacattgtgcattcagatatttttttaagctgacagactagttagatgaaaagagtccagactgaaatgtttggaatgggtgtctcaatcctagattaaaataagtactctttctaacatgtcttaaga

SEQ ID NO: 337202 - DNA, 474 bp, Homo sapiens
gctcctcaggtatggtttattgggtgcagctccttgggtgcacctcctcttgaactagaggcctgtgagctgaaaaattgtttcttccctgctgccaacagtcagtgatgaaacagggactgaacaactactatagacacttccattcaaacggggaaaaaggaagcagcagtcactcatttatagcaattctgaaatccagtcaagcacatgttgctagttccccctaatcccagggcaggaaattttccttgatacatgatttatatgtatgatacacctctaattcccatcccatcccatcctaccccacaggcttcttccttgtcttcctcggttctgtattggtgtctcccttctccaacagtattatttactcacttgctcaatccccaggtacaacaataaaagttaacagaattttaacactcagatcactatgaaaaacaaactaagttgatttctaaatttctg

SEQ ID NO: 337203 - DNA, 192 bp, Homo sapiens
tcttgaccctcatctctaaaaataagataaataaataaaaatatttccatcatcacaaaggtctattggacagggctgctctaggctagacaacccaggtttgaatcagactgcattagcatccaaactgctaatgcatttccctgggtctcagtgtcctcatctacaaaatgggataataaaagttcccat

SEQ ID NO: 337204 - DNA, 490 bp, Homo sapiens
tagctacctgtggctcgtggctaccatattggatagcacaggtctagatgactgtggaaactgagaggttctttgtgacacccacatcctgtaattctaagctctaaaagttgagggttcaagaggagcgaagctctttcactattcagtttttggagggtcaggatagtttcttcaccttctttgtgtctttcactggtgcttcttgcgctctgtagagtctaggagtaagtagatggttggctgagtaggtagatggaggcaggtgcatgtgtgatgggaagtgtggtgacgggttgtgtgggcacacgggatgaggcgcagatggctgggggtttgggaggtgaatggatggtagaaggaggcagggagggaaggaaggaatgtggacggatgttggaattgacgtgtgtgtgagtgaatgagtgtttgaatgcttggaggtttaggagatggctggatggaggaatagatggaaagctgggggcat

SEQ ID NO: 337205 - DNA, 119 bp, Homo sapiens
atgttgaaggaggcacagggcttcatcatgtcttggataggaacttgaggtattgagtgtgatggagggaataggattgccaggcgtgaggtttttttttttttttttttttttttgtg

SEQ ID NO: 337206 - DNA, 289 bp, Homo sapiens
aggagggggagcatgcaggtgagcaagtacaggggccgaggcgagcacttttgggctctggccccacagcagtgtctagggttgttacaatgctcttttagccctcctgtctgaggacggcttaagtgttaaacggcttaagagtcagtgtgacagcctttttgggttcagcatcccgaattatctggcgtccaggaagaatcaggtcacatggacttgaaggatggtgaatgcgggattttattgagtgatggaggtggctctcagcaggatggggagctggagatgg

SEQ ID NO: 337207 - DNA, 918 bp, Homo sapiens
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagaga

SEQ ID NO: 337208 - DNA, 836 bp, Homo sapiens
gatttcatttttttttttttccacatagagttcagctttgtttgcttcgtgacgttggggggcacatttctgctttgaaggaaaacgaaagctaccaagttttgggagatgggagatggtgctatacggtctttagggttacgtgaagtcaagtaaaatcgcacactgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagaga

SEQ ID NO: 337209 - DNA, 759 bp, Homo sapiens
gaggagtgcacttctgtaaaggatgggggtacacatgctgtaactggtggggattgagtggaggcctaccgaggcattgtaattattctggattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagaga

SEQ ID NO: 337210 - DNA, 2045 bp, Homo sapiens
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgggaagagatggatcaagatggtgaaatagaagactccaccaatcatccccttcacacgaacaccaatttaacaactatctacatgcacacacacaaaagcttcatcaatttaacaactatctacatgcacacacacaaaacctttgtaagaactcaaaatcagattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337211 - DNA, 1693 bp, Homo sapiens
ctgaaaagcagacagagctcccgaggtttgatatccagaggaaggccactgacaaatagggtccggacctcctcatcctgttggctggcgacactcgccagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337212 - DNA, 1754 bp, Homo sapiens
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337213 - DNA, 1468 bp, Homo sapiens
gtttattcttagtagttggaactaatgtagtctgactaaaatacacatgggtgtctgctctgtgatgtttaaacttatctgttttgtttgtttttcatttcaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337214 - DNA, 1594 bp, Homo sapiens
caggtgactaagcatccgctggtacagtcattgtattttgcaacccacataatttctgacgcgttctcacagattgtacctgacatacacgacattctctgtccccccggcatttcatacttatactgccagtcatggatcgagggggagcttttatggcttccgtgaacccagacataatcatgccttgtttgtcttcttaagcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337215 - DNA, 641 bp, Homo sapiens
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaattgatgctatgctttaaaataaactcagtacttttagaaacataaaaaaaaaaattc

SEQ ID NO: 337216 - DNA, 1849 bp, Homo sapiens
cgagattccctattaaaaaaaaatagaattgatgcaaacagcctgttccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337217 - DNA, 1882 bp, Homo sapiens
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337218 - DNA, 1828 bp, Homo sapiens
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaataaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337219 - DNA, 1760 bp, Homo sapiens
ggtttctcccgtgctggacgcttcctgcctttgaacgtcggacttcaagttcttcagttttgggacttggactggctctccttgatcctcagcttgcagaaatgcctattgtggaaccttgtgatcatattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcttatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaattc

SEQ ID NO: 337220 - DNA, 888 bp, Homo sapiens
  misc_feature (840)..(840): n is a, c, g, or t
ggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgatttacagaacncctcccctcgcatacatgcactaggacgcgctctaaggaagatacgtc

SEQ ID NO: 337221 - DNA, 83 bp, Homo sapiens
ttgttctttgaagaatcaacaggacccgattatcaaagagagacctgtttaaatatgtacaatcattttcggtattatttagg

SEQ ID NO: 337222 - DNA, 334 bp, Homo sapiens
gtggagatctgcctgggcatcaagcagagaaggcctcaatccaccactatctctgcacaggaagggttaggaaactcaggctgctggtccgggcaagcagttgctccaaatgcatggagttctgcctggatgtggagtgaagaggcccccctgcatcaggatctctacacaggaaggatggccgtagctcaggctgctgaaccagggagcagttacatgggtggatgatcaaagctggactactgctcttgacaatgacagcaaaggatctgactcttctctggttttcttgtgaataaatcttttgaagcaatgaaatgtcacatagccttaa

SEQ ID NO: 337223 - DNA, 456 bp, Homo sapiens
ctctgtgtgtttgtgactaagaaacattgacacagtatttgatccactcctcctatgcccttgcctctgcttcctgagctcctcagagccaactccaaagaatagacctcccactgatctgtaggttcagtccctaaatcctgtcctgcaggatttggaattaagccactcttcctggtctagaagcccaggcaggatttctgagcgcctgcactgccatcaggcctgagctctcctcagtctccctaaactatgccctgttattctgtgagagtgtcgagtcttccatctctgcctggagcctagccctgtgcccaagctctccaagagtcttgtcacccaactgaatcccaactaattagaaattctggtatataccccataaatgagtttggacatggagtcagttttatctcagtactaccagtacgtagcacagggctgtgcacacagtag

SEQ ID NO: 337224 - DNA, 466 bp, Homo sapiens
gtgtgtgtgtgtgtgtgtgtgtgttcatcacttgttgcttggggtgggaagagacaacaacaacctacagaatccatagttctcagttcatctcccatcctagtccaatcatggcctaacatccttagctaccgatcgcagaggagactgcgcatttgtgttcatgtggccttggatgttggcagattcagattggtgccccaggcatctgtgctgtaactgcagtttcagcgggctcaggaccaggctaaagggcctccaagcttcctccagtttcctggtgcatgcatgtgcaatatgctcccctggcctgggtctttcctgccgcttcttgccagttgggtcagaactagcttattaaccagtttttcttctgagctttaatcgaactggctccaaccagttggaggcttgaaaagggctacgtgatagttatagatttttaaagatatattattattttaga

SEQ ID NO: 337225 - DNA, 195 bp, Homo sapiens
tctcctcaatcttaagacataatagccaaatgcatgcatgaatgcttactgaatcctggatcaaaacaaattagcaaagaatttttggggacaattgaggaaattttaataaagactatgtattagatactattaatgcagtattgattttctaggtataataactggttaggtagaagaaatggccctatactc

SEQ ID NO: 337226 - DNA, 382 bp, Homo sapiens
atctgcctatctcctttggtgaaatgcatatatgagtatcttgcccactcttaactggattgtttctaactgttaaattctgagaattctttatatattctagatgcagtcttttatcagatatatgctttgcagactttcttccagtttgtggtttgtctttttcattcttctaacagtgtcttctgaagagcaggttttaatttttatgaattccatttatcattttttttaaaatgaattgtgctttttgcataacatccaaaaattatttgcctaacccaaggtcacaaagattttcttctggcaactttataattttaggtcttacatttggctatgtgatccattttgagttaatttttaaatatggtatgaggtc

SEQ ID NO: 337227 - DNA, 661 bp, Homo sapiens
gacactgccagttcccaaatcaaccaaaacttagggagttctcaaatgaaataaacaccattgtgccatttccgttaatatcacttctcaattttaacaaacttaaacacatttttagggtaaaaagcacatccatcagactgagtctaggttcagggtaaattctgatctggatttgaccaagggaactgaagttattcctgcagcaaagatttgaccgatggtggatttgactgaggcaactgaagttattcctgcagctaagatgggctctctgatcttgcccacatggtctctatttctcgtagattccaggagccttagaggtagagcctttgaagccattgattctcaaacttggctgcacattagaattgcctgaggaacctaaaaaactaccagtgcccaggcagtatctcagaccaatgagataagagtctctgggggtgggatgcaggcatgagttttaaaaaaagcagttccctggacttactccaaagtgtagctgaggttgagaaacagtgattgaaacttcctctagtgagtccagcccctctcagaaacccatcataactggtcagcaccctgtgctggagcatccccagggtgagcctcaggatgtcccgaggtgacccttctggggtaggtaatgttgctgttc

SEQ ID NO: 337228 - DNA, 395 bp, Homo sapiens
aatgacagtagggtaccatcagtgtgggtatggaggagagtgggagtcaagtgaattctcagacttcacagtcactgtggtcctgctcacttgtaggcaacttgtgtcaaggaactgaagtcactgcattgaaagacagattgttggaagtggttcttttttactttggtggtgcagtgttgtaatttctgaagttcctgggaagttttgccctgtcttcttcctttgagatgtttcaggtggggcagctgggcaaatttgctgctgccttgcacatgtgtgagcagggaatctgtacaggaggttgctagtcacaatccttatttttagaaagggctcaaatcctgtgtgtaaacactatttcatactgattctgctctggtggccacattatg

SEQ ID NO: 337229 - DNA, 695 bp, Homo sapiens
gactcgcctgtaagcagatcagagaaattatagaattaggatctctccaacttggtgatgaaagcgtgagattttcaggccttgtcgtaagactggacaggctactttgtctacggagtagccattcttgtattcctttactttcttaagaaatgtgctttcacttaaaaaaaagactagacgatgctccgtgccctgctgcctcacaaagcctctgcgtgtcggtttatcaaagatcccacgaccaggaggggccctgtggcttcggggcctgtagcctcccagccaggagcagcctgggtctcagttgtggctccctcagcaggttctcagccccccaaccaaaaggccttggcacttcacatgaaagctgccgcttaccctacacacactgccaccgggaggcagctgttgactcgttcgttcccctttgggccctgctctgggaacagtcccttctaggcagttaacctgtgagtcatccagcttatagttcctcataaagaaagaaactagccctaacttccacaacagtctaagccgctcctccactggctctcctcagctgaaaccactcagtctattttactgaaatattccttgtttgtagagcttcaggctcctccctagttcggagaaagcaattctatccactttaagcctttagcttttagtgctcaaagacatctgagggc

SEQ ID NO: 337230 - DNA, 245 bp, Homo sapiens
actttttgagcatacgatgtgtgtgtttctatctttttaaagtagaattccaccatgtatacagttttgttattgcagtttctaaactcagtttttatctgggttttctttcctgatgtcagcttattttagaaaaaatagccaattcaaagttttctcagtcaactcaagaaagtgttctcagtcaactcagagactgtcccattcattctttctttctacatgataactgtatacaaaagtat

SEQ ID NO: 337231 - DNA, 337 bp, Homo sapiens
taggaaaatattcagtagtcaaaaatttgtctccagtgagaagcctctgtccctgccgagcacagccaccaaattgtggcctctccagagatggccactggaatcggggacctatgtgtctcttcagaacattctgattacagacgggacatgtttatggatttccttcagtcttcgacacacacaaaaagatgtgtctctatactcttctgcaacttgtgctctttgctgaacaatatacatcctggaaattgttccaaatcagcaaatacaggatttgtccttgttggcacgccagaatattcctctcagtctcccaagaatggacacttagctt

SEQ ID NO: 337232 - DNA, 394 bp, Homo sapiens
gctgcaggagttgcctgctggggctaagattattccttgtgtttgggataaaggaggggtcaccgcaggggcagtcaactcatgttgggggagacgggatttgcattctgggctcccctcctcgtttatgttaagggtgttgcttgctgatgcttctattaactcttactttgggataatgggaagagagatagttttctggggtatgagtttgtcacttatgttgtagaatctggggggctgcctgttgagattctgaccattgcttgttttgggtgtcattgctggggatacttatttatagtcttgggaagacaagggatgcatgttgcagcggtagtgggtaagaatggtggcatttgctggagttcttttttttttttttttttttttt

SEQ ID NO: 337233 - DNA, 373 bp, Homo sapiens
ttcactgcagcctctgcctcccagattcaagcaattctcctacctcagtctcctgagtagctgggatcacaggcacctgccaccaccttcagttaatttttgtatttatagtagagagggggtttcaccatgttggttaggctgatctcaaactcctgacctcacatgatccacctgcctcggcctctggaagtgctgggattacaggcgtcagccactgcacccggccacaacagcaagtcttattgattctgttggtgttttgctttttttgggtggtggggagtcaggtttattgtgttatgatttacatacaccaaagtttaccctttaaatgtacagttctataaattttgatgaatttataattgtg

SEQ ID NO: 337234 - DNA, 288 bp, Homo sapiens
tgcttttcataccatagcccaaatggctcttcctcatgaaagccttctgggactttcagaataaaacaggctactctatgtatccttacagctgcctgtacttttcctcgataatacactcgatagcacttatcactatacatatttataatacaacgttcttagcccacctacattccccaagtcgcctgagaaactaatgtgctccatttcttctgcaaaatatacgataggcctacctggcacctgaatggcagaaagactcctctagtaacccacaccatcctg

SEQ ID NO: 337235 - DNA, 505 bp, Homo sapiens
gctctcaataatctctcccttttctcatattgcacatggaggcagcatcttataatttatcactttttcatttgtttttgttttccctccacacccccatttatacttaagttctacttagcttttcatgtctcatgtcttttgaaagcctccaagaagctggctacaaactatgttacaggcaaatatttacatgattaaaataatttcaagatttattaattcttctattatataataaactaccctatatacatttgtgaagcaaaattgtcccaatttaacctgctactatgattagcttttgaagataattccaaataaacgacacaggtttgagtggtctaagaagcagtctgtgccatcattgtgtattagcccaacccttggttcctagcccattgctacctgcctgttatcttagtgcttcacagagcttctgtccctcactcatgtgtgggctgacaaggcaggctgtgaactgaacaagagatctgaaagaact

SEQ ID NO: 337236 - DNA, 352 bp, Homo sapiens
tgtttatttctgcataaaccataatacaagctcttgtccacattttccttttgctcatcttcctcctgactgaccctggtgcttccccacgtggccctgcgtactgtggcatgatatgtctccttctcctgggatctgtgagtaacaaactatcactcagtgccaattgtttcctaatccactggccaccctgtgcctgaataataataacacacatcttacaacacacacgcatgtgcacatacacatgcacacacacacgtgaacacatatacacatgcactcacactttagtccctctctcttctttattttgctccataccactcattactgtctaacatgccctatc

SEQ ID NO: 337237 - DNA, 370 bp, Homo sapiens
ccacgagagaggaataaataaagtcagcaagacccaactcagcagacagagaatggggaaaatgaggaagaagagacctgatgaagtcatgacatcgtgaaaggacaaaatagatgaaatctgggcagaagtgatggaccagggtgaggacttgggggccaggggagaatgagttgctgaccttacaggccaataaaccaatgaagtaacaaaacaaaagatggatgaactcatagattacttgaactacagtagtcctcccttatctgtggtttcactctccatggtttcagttacctgtggtcaaccgggtgggaaagtattaaattgaaaattgcagaaataaacaattcataagttttaaattacg

SEQ ID NO: 337238 - DNA, 223 bp, Homo sapiens
cagtttccaggccccatcttattggacatctctgttgtgtttggcagtgctcatcactcttccacctcagagcccacactttttgacttctgcaactctgaagtctggatcatcccattcttcccttctcttcctttctcgtatctttgggcttctctaccaccctctgcagtttgtatccttgggggatccatcttcagcccgccgctgtccccattcacat

SEQ ID NO: 337239 - DNA, 373 bp, Homo sapiens
taatgaaagctttaggccatgccagcaaactagacaccttcaagaccaagacgaactggtatagaagacaaggggatgtggggattggagcaaactagagaaagcacacaggagaacacatgccgtcttgcagaagttgcatccactcagcttcagccaattgttgctatgcgggaacatggacccaaatcttacaatttcccaagccatgctagaaatctaggttttagtgtgaaatctctttgttaaatttaggagacttaattgtaaaacattttcaaaatactgtcagtgagctgccagttttcaatttctgcttctgaatagcctttggaagacctctgtcacctttttttttttttttttttgggag

SEQ ID NO: 337240 - DNA, 3814 bp, Homo sapiens
aaagctggttaaaaacgcagattgctgggtccacccagcttctgatgcaataggtctggggttagaaattttgctttctaatgagttcccaggtgatgctgatgccaatgatgtgaagcccgctcttcacatccgtgaaaatcgctgccttaaggtgctcttaaattgttatagattggtagatcctacctttccatcactggtatgttttttgagaaaaggatcctttcttttcattctgttatattcatcctattacataggatgttggttagcacagagtgggagctctagaaagattgttgaccaatcatcttattgactagaccatctttctagagtataactattttggacacctcaaagatgaagtcagataagctggcagtgacctgattaacgttgtggtaagcagatgccactgtggctgggaagtaccaaatcttctgttgagtgattcagtcttcctgactagatttgccttctagtgggtgtattaataagcgttagttgatatgaattaaatgttgcaactttctatgggtaataagaggatacctttatagtttcatgatgtggagaccaagatacataagaaagcaagaatgagtctccgggtgttccctctgatcagcaaacatgaattcataatttcatttactctcatttttgtaatgcactctgagcaatcctccaggcagatcctatttactaagcttcaggcttttgtcccattttataatgcccaaacacatggagaaaacattttgttgtttttaaaaacaggtatgggatttctgatataatcaattttattgacttcttgggagttgtaatgatctgtgactcactgcataatattgtagttttatagggtggcacatcaccctgtgtaaaacaactttaatgacctgaggactgatgagtacaggaagtgaggtttatcatgagtagcatttattaagcatctgctagaatcaaagcactgcattagctactaaggtacaaagtaagacacagtttaataaggaagacagggcatctacccaagtcaacagttcagtgacatctgttatttgaaccacacaccaatgcaaccgaagtaaatgctgaaagggtgagaagaaggaatagattactatgcatttttgagaggatgaagaaggcttcttggagaaggtttctgaaaagagatacggaattaagagaaatagaaaagagcactgacgaagcactcaggatggctattcaaggaattggggatccacagcagctgtgcacaaccatccctaatgccagaaaaatggggtaagggtgaagggaactgggtctagagctttgcatgtttttttctggttaacccttagagtcaccctgaaggtgtggatcccatcttataataaggtgaggacactgagtcaggaaactaacttgctaaaatcaagtcctcccagtcctcccatcaggtccttccagatctggaggagccaggatttgaactcacatttgtctgacttcaaaatccatgctttttcttgtgttccaaattgcacaatggagtcactgccagttcaagctcctatgaaaagggatggatgtgaaaagtcatttgttgattccacagatttttagtaggtaccatgtctcctgcctttatcactatcctactcctctgctacaacttctctgctacaggcacccactgcagttacttgatatgagttaaatgaatccatccatccaaacttccattcattgaataaatacttagcaatggcttcctttgtatcaggcactattctaggagctggggctacagtgcagatggaaaccagcaaagctcactgccctcatggagcttatatgtgagtgaataaatctcagggtggttctcctgtcataggtcctggctcctctgccagctcttccaaatgggttcagagaggttttctccttgtcctgttgtgtaactgataatcccatggtggacctcactttgctattcatatgcactaagtagtttatggtgtgctttgtggctggcaattgtgacagattctattcttctattggtatgtggtttctttggggcatttgtttggatactgatggcatcttccgggggtctgaggcacctacacaaacctcaggtcactatcacgtgatactggagttgcctgttaaattatatttcttcttccacaaaactgcaggttccctgagggaaaggtctatgtcctgctcatttttggatccctaatggctggcacagtacctggtgcataatatggttcaacaaatatttgtaaaatgaatgaatcaaatagtccttcaaagcatcttcagaatcaagattgtcatctagattgcacccgaagtttatctttctagtattcagaatataatcaatcattgcttaaattattccatttcatcattcttgaataaaagctactaattttaaatactaatatctgagatatcttcgaaaagaagattagtcgttgtatgtgttgcttataaattttctctatggtggaaaatattcccaaaccatgtctaagcaatgaaaaaccagtgttctggcaggaaataaactgatgtttgttgtgttttgtatctgtcttcccgttccaaatcatttatatatacttgatggtctgtgggcttgacttgcaagtattttcctgggagacatttttattcaaaagacctgtattgcctgccaaaccttcatttaagagactcattatggatgtcatctgcatcattgcaaacttttctggtcgtctctataaatagcaagataatatttacagagttttacattggctcttgaattttaaaatattcttatagacaaacattaattggaatggggggtaaggaggtaggaatggcttacttgcggaaatgcaggctcattgttgtgtctagtaggtgctaggtgcattcacacatctcttaagctttaaacaacctattgagccggtttccatttccttgatctattagatttaaaaaaatgaagcataaaggagttggctcttgccctaagtcatactactgatggaatgagaatacaaaccaaaaacactttattcaagtccaggaaatatctgccttgaaaaagaataacttaaaaattaaaagtgtcctctatttgaacatgaaaacagctaataaagatgtgttattttattttattattattaattttgtcctcccatattggcaaagataaagcaattgacaaaaatggaattcttgttcaatactggcaggagtgaaaattggtagaacctttctagaaggcaatttggcaacatgtatgaaaacctaaatgttgatacacctttacccagcagtttgtttaggaatttatcctaatgaataaaagttgtccaagtcttcaaacatgagcccaaaggtatatttcatgatgtttatgatattaaaacattggaaacaactgaaacatccttcagtaaaagatggattaaataaattccatgcagttgtcatttaaaaatatttagatatatgtttattgctatggatatatgttcccaaaatattattgaatcaaaaagtagactacaggatatatgttgaatatgagctcatttataacattgaatattttaagataatgtatgtttcatagagagatcttcaccaaatgttaaggatttttttttctgggctgtggtatttgggtgatctttacattcttcagactcatgtgtgtttgaaactttttataatgaacatatatcatttttattagaaaagaataaagtttttgaaaaaa

SEQ ID NO: 337241 - DNA, 1367 bp, Homo sapiens
aaagctggttaaaaacgcagattgctgggtccacccagcttctgatgcaataggtctggggttagaaattttgctttctaatgagttcccaggtgatgctgatgccaatgatgtgaagcccgctcttcacatccgtgaaaatcgctgccttaaggtgctcttaaattgttatagattggtagatcctacctttccatcactggtatgttttttgagaaaaggatcctttcttttcattctgttatattcatcctattacataggatgttggttagcacagagtgggagctctagaaagattgttgaccaatcatcttattgactagaccatctttctagagtataactattttggacacctcaaagatgaagtcagataagctggcagtgacctgattaacgttgtggtaagcagatgccactgtggctgggaagtaccaaatcttctgttgagtgattcagtcttcctgactagatttgccttctagtgggtgtattaataagcgttagttgatatgaattaaatgttgcaactttctatgggtaataagaggatacctttatagtttcatgatgtggagaccaagatacataagaaagcaagaatgagtctccgggtgttccctctgatcagcaaacatgaattcataatttcatttactctcatttttgtaatgcactctgagcaatcctccaggcagatcctatttactaagcttcaggcttttgtcccattttataatgcccaaacacatggagaaaacattttgttgtttttaaaaacaggtatgggatttctgatataatcaattttattgacttcttgggagttgtaatgatctgtgactcactgcataatattgtagttttatagggtggcacatcaccctgtgtaaaacaactttaatgacctgaggactgatgagtacaggaagtgaggtttatcatgagtagcatttattaagcatctgctagaatcaaagcactgcattagctactaaggtacaaagtaagacacagtttaataaggaagacagggcatctacccaagtcaacagttcagtgacatctgttatttgaaccacacaccaatgcaaccgaagtaaatgatttgtctgacttcaaaatccatgctttttcttgtgttccaaattgcacaatggagtcactgccagttcaagctccttagtaattgaagctatgaaatggatttgtctggtatcccttgagtaacaagtcttgagaaggcatgtgacaaagcaatgcaagaggcaaaaaccagataagctagaagtaaaagtgagaagagccatttcgacttcaccctttggttgccagacctctgttttctggctgtgaatagaaga

SEQ ID NO: 337242 - DNA, 269 bp, Homo sapiens
ttgattttctaatacacgtgtgccatttagttatctgtactgtttattggttggtattttttgttatttagctcttcttcgggcatagatctttgggttttgtttgtccactggtttcccaaggcaccttgaaaagtgcctggtatataatcggcgcttaataagtaaaaaatcaacatttaattcttcaatcaaatgcgttacatataggtatggcttccatataaatgagcagtaagccagccttccagccactgtgcgagtgccat

SEQ ID NO: 337243 - DNA, 244 bp, Homo sapiens
tgggaaaacagtttactagagtgttcgtgttgattgtttataagtaactcacttatcactaacaagagaatatgttaaaattggttaggaatgaaactctggaattgaagtttctaggtaggaattgaagaataaggaagattatgattttgtgcaaaagaaaagagaatttaatagtgctaaagaagtagaaggatttcagagatgagcagtgggagttatttgaggttcctgattcagagga

SEQ ID NO: 337244 - DNA, 529 bp, Homo sapiens
gccttgctgcaacactctcttaatctccaccgctacacactgccatcatgaacggcacggtaactatccgcgttagaaagttcatgtccaaccgactacttcagaggaaacaaatggtcattgatgtccttcaccctgggaaggcaacagtgcctaagacagaaattcagggaaaactagccaaaatgtacaagaccataccggatgtcatctttgtatttggattcagagctcattttggcggtggcaagacaactggctttggcatgatttatgattccctggattatgcagagaaaaatgaatccaaacattgacttgcaagacatggcctttgtgagaagaaaaagacctcaagaaagcaacgaaaggaacgcaagaacagaatgaagacagtcaggggaagtgcaaaggccagtgctggtgctggcaaaaagccgaaggagtaaaggtgctgcaatcatgttatttgtggctgttgtggatttttcacaagaagattaataaactataaactttaaaaagtaaa

SEQ ID NO: 337245 - DNA, 268 bp, Homo sapiens
ctgttgtgtgtatgtgttcagagtttctttagacatcttcttgcctctagtgatctctgttcaatatcacattaaggtagttgggcctaggttgtcagttatctcccagcttctttaattttagtgggaatttggaagtttggattgataattggaaccctcctcctcctcctccttcttcctcttcctcttcttcctcttcttcttgtttcttcttttttttttttttttttttttggcagggtcttgctctgtcacccagagcaag

SEQ ID NO: 337246 - DNA, 277 bp, Homo sapiens
agggagaccgtggggagagggagagggagagggagaggaagagggagagcctgtcagtgttattgtctccttgaagtaaacttttttgtttctctgattgctttttacatttttttcttttacttttttttttggcagttttattttatgccttgatgtggtcttctttttatatttcttgcttgagttcagagaccttattaaagctctgtcttcttttctcaattttaggacatgtttagtcaatatctctttctcctcctgagacttcaattac

SEQ ID NO: 337247 - DNA, 428 bp, Homo sapiens
aagtaatgactagcagtcaagtaaggctagtagtctttttttttttaaaaaaaaaagacagggtctcactctgccacctaggctgaagtgcagtggcgcgatcttggctcactgcaacctctgcctcccggctaaagcaatcctcccacctcagcctcctgactactggtgcatgccactgtgccaggctaattttttgtatttttggtagagatggggtttcaccatgatgcccaggctggtctcaaactcctgggctcaagtgatctacccaccttggcctcccgaaatgctgggattacaggcttgagccactgcacccggccttggctagcagtctatttccactttacagatgcagaaactgtggctcagagagttactgggaaatacgacataataaactatcctatactgcctgcactttt

SEQ ID NO: 337248 - DNA, 340 bp, Homo sapiens
atgtccttagccataccagggaatgtatcctgaacagtaggagatagaggtggagaggaacaatggttgagattgtgaaagtcttagcccttttggtgattgcatgccaccctgtgtgtcctaaggagacattcagggtttttgagtgagggaatggtgtaatgaacaactgtaatggaagggttttggaaagttgtgttagggggacacatcagtgagcaggctgttggagttgcagggtggccagagtttgcactgggatcactggaagtgaaaaaggtgggtttgagaaacattactgttgaaataatctgtttacagggcagggtgaagggatgag

SEQ ID NO: 337249 - DNA, 158 bp, Homo sapiens
aaatccaagctccttaaagaccctacatgacttggctccactcacctctccagtctcatctcattatgctttctttcttgcttaatctgctgcagccatgcccattggtcttattgcctggctctatttttctttaaagcgctatcactacaggccat

SEQ ID NO: 337250 - DNA, 393 bp, Homo sapiens
caggcattgccaggggagagatgaaggctcaccagatgtcggtccatgagggagctttcactggtctgtagtgaaatgtggagtgagaaaaaataagaatgacaccaatggtgagcttctcataaagcaaattattccatttaatttgcaggtggaggggcctttttgtcttttgcttctgtagatgacttttgatgttacttgcattatgatcagagcgtgttgataatatttctacttcatggaacttcctgatgttttctccgtgattataggcatgagccaccattcctggcttaagaaaacttacttaaatcacttatatgaaggcaactttcactgcactcctaggatgcattcctttttgtctgttttgagagtctccgtcgaact

SEQ ID NO: 337251 - DNA, 300 bp, Homo sapiens
attggttgccatctacgtacagaatgtgtgaggatggggctgggggcggtggctatccctctaattccagcactttgggaggctgaagctggtggcttgcttgagcctgggagttcgagaccagcctgggcaacatggtgaaacctcatctctacaaaaaaatacaaaaattagtggggtgtggtggcctgtgcctgtggtctcagctacttgggaggctgacatagaaggatcaatcgagtccaggaggttgaggctggagtgagccatgatggtgccactgcactccagcctgggtga

SEQ ID NO: 337252 - DNA, 90 bp, Homo sapiens
ctggcctggaatacttcttaataaggtatttttaaaagactttgaaagtttagaaacgatacatataccattaacaaaagaataattctc

SEQ ID NO: 337253 - DNA, 572 bp, Homo sapiens
agggactaccactttcaccttttttgaagtcttcgaggatggtaccagtctgggctgtttcttccctgatgtggcattgtttttcactaaccgtcttggtttgagttgggggaaggagactgtgccacgggcttctccttgacttttccagcttagtagctcttacctagtgagtgaaggaaccaatgtgagggttctgccagtcatttcatgtatatatttgggaactagggaaatgaccatgggtggatctgtggatctgttgtgagctagactggggccaggactcccttcataacctggcttccatacgccccctctttatagggagaacgtggtagtgctttgggtccacagatagtgtccattcataccctaagttcaacaaaaccagaaagctctgggcactcccctttccttaacacactacttcccaagcaagtggccaacagccctatggagaaagactggggaaatgactattgatgacacatgccttggtgttacagggacctgcctaattctgttctggcgttcctttaattagtggcttccaggtttgagaaatggct

SEQ ID NO: 337254 - DNA, 270 bp, Homo sapiens
tagtttcaaatgaataattgaaattgagggaaatgagagagccacaggtggattcaacctgggccagctggactgctgaaagggaagaggtatttatacaatgcttagaatttagctgcagaaatgattggatgggtcagtggtgatggagtggggttgagagtttcagatgggtaaactgaacatgtccattaccaggtacagagcacgtgatgacaaccatgaactgtgaaggttggggagctgctgaaacagaggaaaaaggggaga

SEQ ID NO: 337255 - DNA, 118 bp, Homo sapiens
tgtttgtgaaggagaatcatttattgatcctcagacagattctaagcctcctgagggattgttaggattccacacagactggctgacattaaatgttggagggcggtactttacaact

SEQ ID NO: 337256 - DNA, 402 bp, Homo sapiens
cctggagaacaaggatgttgcgttattaatcttattctcagtgtttgtcagtgtctgctaaacatttgttagagttaatgattgagtgaataatgcagggattaattcgtgaatgctttgtgaaagcaatggagatatggatgtggactggtagagtggaggaccttcctctaattgaggcttggagtggagggcagaggaagtactccagagctggaacaaggacatagtgatgagcataccatgtgttgggaaggcaatcctcagattacataataaattagaatgcatgccaatacagactccttaggttgcaagtcataggaaacctagctcagagtggattaaacaacatcacacagcaactcttgacttttttcaaatgaagaattggccccaaag

SEQ ID NO: 337257 - DNA, 284 bp, Homo sapiens
tgggggtggttcctgggcacttctgtctcctctaataaaagaggccagtgactttggccacagaatacacatccacttctcatgggttcatatccaaagaacaaactccttcagactcgctggtccatgcactcgagatccccagggtatcttgagttattatgtcaaaaggagagagaaaccagctaacactagtcctaatacttatacgaatacaaagagggatgttttcttcttgctgttccagggaatgtgctgagttaacaccttttttctttttattg

SEQ ID NO: 337258 - DNA, 440 bp, Homo sapiens
agcatgggagaaaatcatatatctgcctgaaaaaagaaaagtaaagtaaaaagaaaggaaaagaaaagaaaaaaggaaggaaggaagagagggaggggaaggaaggaagaaaggaaggaaggaaggaaaggaagtctgtcctcatctaagtttaccttatttctctgccttggctatccaaatgagcctcaaaatcctcaatggggtcataaaaatgaccagaccttgaagattgcacagctccatgtaacgtatcacagtcatcaacaaaacttcaactctcagctcagctcaataaacgttattgaggacctgcctcatacgaggtcctgtgtgaagaactagggatgcgaacaacaagatgtgattcttccctgcaggagcttagctctgaccttgaccttagtgaagaagtaaagaaggactggttttctcaatta

SEQ ID NO: 337259 - DNA, 503 bp, Homo sapiens
tttgggtaacaagctgagtggggaaacacacaaaaatgagaccaagacattaatttctttgcatttcagtgaagacatagaactctggagtggagcgccagggaagaacaaagcagttgagggcctctcattataaagaggagacagaatgaggatgctgcccatttgtctgtcatctcccagcaggcactcctggccagggggatgaggtaacccactcctgctgtcatctaagccaagcatctctgccgttcaatttggtggcctgctcatgatgcccagaatcaaggttgcatgaagagtgcctatattattaggagcactaacattaatcaattcccgaaaggaaagttttgataagaagacactggagaactgatccattcataagcagaaaaagacagtcagaacagattgagaatgaatcgggatttacctgctattagggagggagattcttcctggctgacatctagaagagaagcacaggatgatgggaacag

SEQ ID NO: 337260 - DNA, 277 bp, Homo sapiens
ccccagcagtccaaaccacaaagaccacagataggaatctgaggcttggtatagctcaggcctgtgggtgaacgatgagggctgtatgtgtaatacaaaacaggaataagaaattaaggctgagggctgggcacagtggttcagatctaacccagcactgtggaaggccaacatgggaagatcactcacttgaggacaggaattggtgaccagcctaggcaacatagtgagaccccatctacaaaaaatttaaaaaaaaatttagccaagtgtggtg

SEQ ID NO: 337261 - DNA, 468 bp, Homo sapiens
gttggctcatgcctgtaatccaagcactgggaggctgaggtgggtagatcacttgaggcctggagttcaagaccaacctggccaacatggtgaaaccctgtctctactaaaaatacaaaaaaattaggcatggtggcacacgcctgtaatcccagctactccggaggctgaagcacgagaatcatttgaattcaggaggcagatgttgcagtgagctgagatcacaccactgcactccagcctgggtgacagagtgagactctgtctcagaaaataatactaataatcttgagatgagagcatcctggatttaccagatgggccctaaatccaatgacacatgtccttataagagacaaaagaggatactcatatacacagaaggccatgtaaggggactgaggcagaggttgaagttatgcagcccaagtcaagaaacacgtggatccaccagtagctagaagaggc

SEQ ID NO: 337262 - DNA, 392 bp, Homo sapiens
acctgtggtcccagctgcttgggaggctgaggcaggagaaatcacttaagcccaggaggttaaggctgcagtgagctgtaattatgccactgcactccagcctgggtgacagaacaagaccctctctaaaaaaataaataataaaaggcataagtagtggttacatggttgtcttcactgtatgataatgctcttgagcagcacatttgtctttttctgtgtgtaggttatattttaatgaaaaggtttttagagatagaatgggagggctggagttggagacagtgaatacagataactttttgagggattttgctatatagggaagcagggaaatggatggtagctagaagaggagtctggccaacagggggacttcataaagctgggac

SEQ ID NO: 337263 - DNA, 421 bp, Homo sapiens
tttgttatgacttataaacattttatttttttatcatcaacctccaaagtggttggtcatttgagcaggtgcaaacacagtagaattcatatttgttttacctgagaagccaaatgaacttttattcatatggaaatcttggggaaaggaaaccgtacaagagattaagcttagtttcttgaaaagcgggtaatacagctattgagattcaaaactaccatcatttctgagattgaaacttttgaaaatttaagttgaagaaaaagatcagggtttatatctttttaaagctaaaagattaaaacaatgaaagaatttaaggttttaagtaagtctcccttaaaatcttggtttcttcctataaaaggaaactgtttacttacttttatatagaatatgtatttttaaccgcctaaaaatg

SEQ ID NO: 337264 - DNA, 211 bp, Homo sapiens
cagcaagggaagttctcttagatgaagaggggcttggctgacgcaaaaagacaggtcagatttagagaggcaagagtggaggtggcaaagagatgcaccacgaaattgccaatgtgacaacggagggaactgacaacaattaaatcaacactagctggggaacggcttcttgctaagtgatttacaacccttctcatttaattctcagggt

SEQ ID NO: 337265 - DNA, 294 bp, Homo sapiens
ggaaaggtcatcattgctgaggggctggcaagtgtagcacagaagtagaatagggtcatggatagctgaagccacacatggttctgtgtttctgtggagccatgcaaggaggtcctcacagaattacttgagaccaccgctccttttaggatccaatagaattgcaattctgtggtaatattggatcggtttgaatgggccatacactctggatggtgtcagctacgatgtagtgtaaggccaaaaattaaggcccagtgtgatttgccacctggatgcctggtcatattggta

SEQ ID NO: 337266 - DNA, 346 bp, Homo sapiens
aatcgttttaacagatctcatcttattaccttgctggacatttcatctcagtagtttcattactccaagttaggtctttctgtgtgccttttttttctggctaaaattatgttacttcctttggtcatcctgagcaagtgtgtggcctctattcagatatatgcctctgttaaaggcattccacacagatccagcataatgattgagttttgcttctcacctttgttctctccacccagtaaggtgtggagctgttaataaagttcattattttattggccaagattattgatgctcataggttgaagaacccatgacattcacatgagtctgtattaactgcttg

SEQ ID NO: 337267 - DNA, 187 bp, Homo sapiens
ggagcccctgtggggtttccctgaggcctggacattatgtaatctgtctgcgttttatagtgcggcccaagcactctattgagaaatatgagcccaaataaaacaaaggtgaatttgagtgcagttccctagaacaaaaaccctttgcagtcctgtggcttcgcagcagccgctggcccagccctga

SEQ ID NO: 337268 - DNA, 314 bp, Homo sapiens
tgaacttgctagggtgaggaaccaatgatcttttgactttggatctttgaaccctgggtgagctctgctacagcagcccggaccctcagtattcccatctaccactgggaactaggtaacagccaggatggcaggatggtgggtagaagggggaagctctggaagtctgtgcagacagcgtattttccaggtgaattgtggaagagaaagcagggctgacagccccatgccaggagctgggggtacccaagagtaggtggggtttgagtcaggagggttggggccaggagcacaggaaccagacaggcccaccc

SEQ ID NO: 337269 - DNA, 427 bp, Homo sapiens
tttgtatgacctgtcagccgggaaatgtaaggtttttatagtattttggtcagaagcctcttgggttgggctatacacaagaaggtgatccacatactggagtatactcccatcctccaattgcagacccctcagatccctctctaagggttgggcaaagaagtgggggctatcccaaaagccttaggggagcactgcccaagtgtttttctctggtattaggattttcccattcaaaggcaaaagggtattgggactctggaaccagaggaatgaagaagaaagcatcttttaggtgtaggactgagaaccattttgcatcccctggtacctgagccagtagggtatatagatccatcatcaatgggtggagagagataacagcctcattaattattctgagaacctatactaccctgtatttccc

SEQ ID NO: 337270 - DNA, 357 bp, Homo sapiens
ctcttactggtctctccccaggcctcatctgcactcttgggttcagctacctactttagtgaacataccctaaaacgtatttccccaaccctcatctcatacaagtcttactgctctcctttcactccatgcttccctttccttttcccactcgagatggagcttccaccacctgctttgcccagttagcaaatgtgtatccttcattttgtcccagagagcacaccttcacagaagcccactagagcacccagctagctcatacccattctttcatgattatctattgatttgtttggttattgaataatgaccgtatcctgaactcaatttccagcttcgaaaaagcacagacct

SEQ ID NO: 337271 - DNA, 243 bp, Homo sapiens
ttggaagcactgtttcttctgtccttgaccttgttccacatgttttacccattacctcctgtgagcaggcacagggcctttccttgtcacctgggcttcagctgctttgaggatgactacttaccccttgcagtagcttcccaccaaggttcttgaaagggaagttttcataatgttcatttttttaaaaagttagaccagctataccccctaaacttaagtctgcttgttttcatatgacgt

SEQ ID NO: 337272 - DNA, 416 bp, Homo sapiens
gatgcatactaaccgttatgattcagttcttagttttgtctccttctgacctaccttttcctgatttttgtgactgattttgattttatgcttactcttgtgtctaaaagctgtctttcttatactacaatggggaagttacattgagtatgtcagcaacaatgtttaaacaaggggcaaaacctcactataatcgtatgtattttcattaagcatgacattctatgcaaggcttaccttcggggattaatcattagaaagtgccagaagtatccaaaagcgtccagccttgttatgtggcttcctctaaacatcacatcattttattgattaaaatgcttaaaagcttttgtgaataactctacattgaagtatcaatgagtggttcttaacccatcactgtatgcatctcggtt

SEQ ID NO: 337273 - DNA, 168 bp, Homo sapiens
gaacagcaaacatgtccacgcatggttggaatataacattcccagggtaaagcatgggaagaggtgaggctggagggctgtgattaggaaaggccttgtgatttgtccttatcctgaggcagggagccacttaagggtttcagtagacgagtgacacaatcacccctc

SEQ ID NO: 337274 - DNA, 437 bp, Homo sapiens
tcttgcaatattttcccatctctagccatcctagtccaatgtcatcttggctccagcctactgtttcattgttctaatcccattagggtttcttcctttcacccacacccccatcaaggaactggctaatgatcaggtggcaggtttctgtggtcatgccaacattaacctgcaggtgatagggaaactctgagtaccctcaggatgagctatgtcctagtgctgttctttccctgatggttttggaccgaacatttggctgtataaggatgaaaaatgcttctgattacaagtgctggcttttagattccaaaagagatttatgtagttcaacctgaagcttttttgatgtcttgactaaacccacacttagtttgaaagaagctaagagtctgactctagaccaaattaaacaaaattcctttcactcattgttg

SEQ ID NO: 337275 - DNA, 514 bp, Homo sapiens
ggggataaggcattttaactgaaactcgtgtcagcttcattctatttatggcttgtatatcatagctttcccataagtctgccacaaagctgaatgtatagacctcaattaccggctctccaatcagtcccttagttaaatccttccaaatcaattaaagccacttcaggtggcactctcctgaggcctgcatatttagcagcattctgtgcaagtagcaggttcactgtaatattcattggtcaattaaaaggtacacctaacataggagcgattactaaacattaaccataggaggacgagggccaggtcatctccacttttatagccttcatcagctctaagatgaagatgcttgcacacagaagacatccagtaaaaatctaagacactgattgaagtaatcaattatatgaaagttttaaaatatactctatcaatcttgccaacacctgactgtgttgatacagggaagtcccttcccctctgtgagccttcgttttctcagccatct

SEQ ID NO: 337276 - DNA, 352 bp, Homo sapiens
ctgactccattctcagaggaggaaaaataatcctatgcagcctctgaaagtgcttaacctacaccaggaaatgggctaaggattaaaaatgtgcccgcaggagtgaggcaaggaggaagatggaatgtggattggtaaagcagacactctagtgtcctgcccagataacactgggtccctttaatcgtcttgtgtgccctttcccggcttttgtgtgctttgctgctaagggatggtaccaacatttcttaagaaaaaccttcttcaaccaccgaagctgcttcacatgcagatgaagacagcagaggtgcttggaagtttatagccctctcttacctgccacagtcagtga

SEQ ID NO: 337277 - DNA, 208 bp, Homo sapiens
ggttgacaggagggagatggtgtttggggattgagcaggtaggtggggagagatgtttctctgatatcatcacaaaaatcatagaggagagcaaaaaaaattcagtctctagaatcttcatgtactattatatattctaggagttaacgttactcccactctgagggccccagagaaaggttgagtagcttgctctgctatgcatggt

SEQ ID NO: 337278 - DNA, 95 bp, Homo sapiens
atgtggaagcacttttggaactcttaagcagcccccaaatggagcagatgatgattagactgcacatctcagactgagctcctcattcccaaaaa

SEQ ID NO: 337279 - DNA, 1850 bp, Homo sapiens
tgtgttttgaatgtggccaacagcactggacaagagaaaaccatttgtacaattaccagaatgaagtggatgatgacctagtctgccatatttgccttcaacctctgctgcagccactagacacaccctgtggacatacattctgctacaagtgcctcagaaactttttacaagagaaagatttctgtccgttggaccggaaaagacttcattttaagttgtgcaagaagtctagtattctagttcataaactcctagacaaattattagttttatgtccattttcttcagtgtgcaaagatgtaatgcaacgttgtgatctggaggcacatctcaaaaacagatgtcctggagcttctcatcggagagttgccctggagagaaggaaaactagtagaactcaagcagagattgagaatgaaaatgggcccactctactagatcctgcaggtaccttatctccagaagcagactgtttggggacaggcgcagtgcctgtggagcggcacttgacatcagcgtctctttccacatggagtgaggagcctggccttgacaaccctgcctttgaggagagcgctggagctgacaccacacaacagccacttagtttaccagaaggagaaatcaccacgattgaaattcatcggtccaatccttacattcagttaggaatcagcattgtgggtggcaacgaaacacctttgattaacattgtcatccaggaggtctatcgggatggggtcattgccagagacgggagacttcttgctggagaccagattcttcaggtcaacaactacaatatcagcaatgtgtcccataactatgcccgagctgtcctttcccagccctgcaacacactgcatcttactgtgcttcgagagaggcgctttggcaaccgagcacacaaccattctgatagtaactctccacgagaagagattttccaagtggctcttcataaacgggactctggtgaacagcttggcattaaattggtgcgaaggacagatgagccaggggtttttattcttgacctgttggaaggggggttggctgcccaggacggcaggctaagcagcaatgaccgagtgctggccatcaatgggcacgacctgaagtatggaactccggagcttgctgcccagattattcaggccagtggagagagagtgaatttaacaattgctagaccagggaaaccccagcctggtaacaccattagagaagcaggaaatcatagcagcagcagccagcaccacacaccaccaccgtattatagcagaccaagctcacataaggatcttactcagtgtgttacatgccaagaaaaacacattactgtaaagaaggaaccacatgaatcccttggcatgaccgttgctgggggcaggggaagtaagagtggtgagctgcccatctttgtgaccagtgtgccaccccatggctgccttgcacgagatggcagaataaagagaggtgatgtgttgctaaatatcaacggcattgatttgaccaatttaagtcacagtgaggcagttgcaatgctgaaagccagtgccgcgtcccctgctgttgcccttaaagcacttgaggtccagattgttgaggaggcgactcagaacgcggaggagcagccgagtactttcagcgaaaatgagtatgatgccagttggtccccatcatgggtcatgtggcttgggcttcccagcacacttcatagctgccacgatatagttttacgaagaagttacttgggaagttggggctttagtatcgttggtggatatgaagagaaccacaccaatcagccttttttcattaaaactattgtcttgggaactcct

SEQ ID NO: 337280 - DNA, 476 bp, Homo sapiens
aagggtgttcacagaatatgatctccttttatcttcacctcaatgctgtgatgttgcttatccttctgagtttttatagataacacattgggactaagaaagagggaggaagtaatatggtcaaagccgctccttagaaagatttctctggcagctgtggggacagagtagagggaagacagaatgatggtgaggagacctgtcaatggcaacggttcagacaagttgtggggagggctcgaacaagggcagaagccaggctgcaggtggcatgaggcagtgtcacatcagtctcactcactactgtggccaagtctccttaaatgtttgctgagtgaatggatgactgaatggtgtctctgacagagacatatggatgaaggagatagaggtaaagtgcagggaggacccattgatgacaaaggggtttccagatcagtctgtcacggggagcaattcaagagaagaggtggggc

SEQ ID NO: 337281 - DNA, 159 bp, Homo sapiens
gtttggattaggccacaagaaggagcagatgataccatcagatgcttatagggttggggcagctaatgggcttctaaactatttggtccctggcttacttagcaagaagggtagggaagaccaaactctgcactctttttttttttttttttttttttt

SEQ ID NO: 337282 - DNA, 451 bp, Homo sapiens
attccaggtatttgctttggatggttctgtgtttatcctctctctatttataagaggttacttataagaaaaagaacacaaaataaatacaactttagagctttgaaaggtgtccatgcagttgagggtcctgacccttaagtgttattggctttttgataaattcacttctggtgcttactgtaggtagtcctgcctctacaagtcagtaaagaagatgcgatagcaaataatacaaagtcagacagcctcagcagctccttgatcatcttgcttctaggttctcagactctcttatcctgcttccatcttctgggacggcacatttagcttctgatcttggcttccaaatcaactctagttgtacatttttgcccatttttttctcccaaagtctcttaagaattctgatagcaaagaccccaatctggctttccaggtgttctaatgc

SEQ ID NO: 337283 - DNA, 347 bp, Homo sapiens
aaaacagctaagtaagatgaaaaggaaaagtccaaacatgagggggacccacattacttataatagtaaaagactggaagcaatcttgtaaaagtggcacattcactcaacaaaagacagctatagtaacatctgcacacagtatagttatacatatgtccaaaaaaaggcaaaaagaacacaagacaaaggaatattagtgaggtgaaattaatgatttgtcctctactctcataacttgcaatattctttaattactttataacaaaatgtattttaattatcacaaaaagcataggcctggcctgttgaaatacttttacagtcccaacataaatgtcataaaa

SEQ ID NO: 337284 - DNA, 327 bp, Homo sapiens
ggaaggcaagagggagagagagagatagaagagagaaccagccacatcctggggaatgagaacagatgcacaaaggacagagcagcaatgccgaaggaggcaccgaggcaggccctgaagaggagtactctgagaccgatgccccaggaggcttgaggaggatgggcttgggaaaaactgcaacaccaagaccctctctgagacacaaccccaggggcacacccacacacttgcacctgccttatctggcagaggtgaggagtggggcagggaggagcctaaagacctctctgaccctaatgccagccaaccccacagagagagcgt

SEQ ID NO: 337285 - DNA, 349 bp, Homo sapiens
  misc_feature (311)..(311): n is a, c, g, or t
  misc_feature (330)..(330): n is a, c, g, or t
cgaattccagctcggttccctacctctgacagacatcatgacaaaagaagaaagtattcccatgaggaatcattctttcgaaagacttctctgttggttccgttagccagctactttaccagcttttacagtgtaattcactctacaagcagtctcacacaaaagactacatattgtatgattctgtttatatgaaatgtccagaaaaggtaaatctatagacaaagcaaatcagtagttgcctacggcccagggattggctacaaataggctccagaaaactctgggaagatggtagagatgtctttcanaggtagggattctttaaantccacccggaagcatgcca

SEQ ID NO: 337286 - DNA, 642 bp, Homo sapiens
agctttgctggattcaggccctgggtttgcccaggcctgtatgaccttgagcaagttattctgagcttcactttcttcctctatgatggagaaaataatgatagcacttacctctatagagttatgaaaatttagtaagataatccatgtatgcatttagcactgttgagatcttggcttactgcaagctccgcctcctgggttcacaccgttctcctgcctcagcctcccgagtagttgggactacaggcactggccaccactccctgctaattttttgttttcgtatttttagaagagacgggtttcaccgtgttagccaggatggcctcgatctgacctcgtgatcctcccgcctcggccttccaaagagctgggattacaggcatgagccaccatgcccagcctattactcttaagcctagttatttaaatcaaacatttagtgagctcttacatgatgttataggagactctgaagattctcaactgttgattcctgttcataaggcagttatagtcttgttgagaactaagttttatgcagataaataaactagaaagtgtatgtgaattgccgaaagagagaacaaaagtactgtcagtgcgcagtaactgggaagaaaacagtagtccaaagta

SEQ ID NO: 337287 - DNA, 335 bp, Homo sapiens
gggtggtagatgaaaattctatgaaaatcttgaagacaggattaacctgtaagagctccagtaggcaaaaaataaatttcacaaggtatttcacgaatataactgtagggttgagttaataactatataatgaactttttacttctcaaaaatattgtgagtcacattgttgtgcgtgcaatgaatgtttacaaacataacatacactgggcagtagtgtacacaacactacacctaaaatcagggacaaaagtgtaaattaaaaacctaactggctggagattaaaaatattattcaaatgaatgcatcaaagaataaatcaaaggtctaactg

SEQ ID NO: 337288 - DNA, 146 bp, Homo sapiens
ttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaaca

SEQ ID NO: 337289 - DNA, 203 bp, Homo sapiens
atatgctctgtcatttactcgtcacacttctgtctgaggaggcttgttctgctccctcttacaggtgacagggctgggaccgagcagttgcatctcttgctaaagcctgcgatggtcctgccccagctcacgcggccagcacgggctctgcctctctctgccgtctcagtaaatgtttacacgggcatcccttctcctccctc

SEQ ID NO: 337290 - DNA, 502 bp, Homo sapiens
agaggaagagaaatagcttgccagatgcattatgaggaaagaggggagtgaacatgatgttgggaaggggtactaaggataaacgattttcttattttcttgctgatggtcattagtcacttattagctgagctaattgaggagaccagaggaatggatgttgcagagtcagtcaacagccctgaaggttttcactggtcttgaagcatgctgagatactctctgtctgacactgtgaacctgctttctggttggtcctcatcttttctccctcttcatcaagctcagcttgaatgccagatcagtggttatgagaagccctggacattcccagagtgagatcaacctgtgttgcttagaaatccaggttcagttgcttccctattcttagcaggtgtgaacctttcctgaggtagaggaaatgtagctcccagtgggttgataggatagattggacttgggggtaagagagtgtcctcaagcgtgtcttctgtatgttata

SEQ ID NO: 337291 - DNA, 268 bp, Homo sapiens
gtgtctcagaacaccagtgaccaccgttaggtgagcaaggcagtaaaattacagagcaaaatctaacaggccagagctttcctggaaaagaggtttctcaggagccagccccaaacatatccaagggcagttaccagcctttaagtctgaggtttggatttgagaattaactttgaaactagagccaaccccaggttaaggagggagcagaaggaaatacaggaagttgatgaataaaaacagaaagtctttggtaccatgagagtga

SEQ ID NO: 337292 - DNA, 206 bp, Homo sapiens
ggctagaatgagtgtgggtaagagtgtgagtgtgtgtgagtccataagcatgcgtgtgtgtgttccctgagtttaggtatatgactaagcacgtggcaactggcccttgacatccacaatgcagggacaaggccataaatacaatcccataatacacacaaaagcatcttgaggttgtgaaaggtgatataaaaatacaatgtcta

SEQ ID NO: 337293 - DNA, 498 bp, Homo sapiens
ggtttgcttgaggtccttttaccatgagcatccctttccaaagaaaatgggcaagcttgctatttaatacagctagaccttctctcactaagaattgaatgattcttcagtggaaaaaagaaaaaccatcagggctttaaatgttctgattgggttggaatggaggagagattattctgggtggatagagaggaggaaggaactttttttaaaaaaaactaagaaaccacattttatcatgtaccagataaagatacctggctactgagacaggtttcctaagttacctggacagtaatgacaagactcacttgtttattagagtcagaagataatctgtccttacgcattttcaaaactatcatgagaatattttcagtgaaacagattgcagaaaagatagatcttagaacgtaatcttaatatcagctgtgagcattaatagacagtcactgtcaagaactggcttaaggctgaatcaaaacatagataaacaac

SEQ ID NO: 337294 - DNA, 195 bp, Homo sapiens
tgctgggattacaggtgtgagccactgcgcccggcccataatgttatatttctaataacctccatcctgtttttatttttttgctattgttaagtacaacatatctgtatgtaaactttccatatcttgtaaaccacacaatgtattcttatttttattttagtcagttttcctttaaagaagttaagtaaacaa

SEQ ID NO: 337295 - DNA, 419 bp, Homo sapiens
atgtggcaaaggtctgcaggctatgtacgcacttcctacctcaagcccaggttgtaagaactcaggtgtaaccatccctgcaaatgattgggcactgggcccagtgggtttgctgtgacaatgatggaagctggggcaggcatccagggagccttgtcagtattgggctgtctttcaatactagagaagcaacattaattctgtgtattggagaactcgcttcctatttccttgtgacccagtctctaataactttatgcctgttggccagtctgtaagctttcttaggaaaggagcaaatagtatttttctttactgagccctgcagtgtttaagaaagcactgagcccgtagcagcactcaacaaaataagtactggctaaataagtagaagacaatgcacctctgaggatgtttag

SEQ ID NO: 337296 - DNA, 454 bp, Homo sapiens
gtatctcttccaaatgcacaatgaaggagttctcatcaacagcacaaggcaatacagaagtgatccacacagggacattgcaaagacatgaacgtcatcacattggagatttttccttccaggaaattgagaaagatattcataactttgagtttcagtggcaagaagatgaaagaaatggccatgaagcacccatgacaaaaatcaaaaaattgatgggtagtacagagcaatatgatcacaggcatgctggaaacaagcctattaaatatcagcttggatcaagctttcattcacatctgtctgaactccacatatttcagcccaaagggaaaattaataatcaagtggagaagtctatcaacgatgcttcctcggtttcaacagcccaaagaatttcttgtaggcccaaaacccatatatctaataactatggggataattttctgaatta

SEQ ID NO: 337297 - DNA, 664 bp, Homo sapiens
tgccagtcaccgagggagtcggggcttaaacccaggcccatctgaccgcaaagccaatgtcctgtgtgctttagaccttcaattccctcacagtttgtggcctgccagacttcatgtggcaggggcttccagcccactctcagctccctgctgggttctggataaatctgagcaagaagcattcagtgccaatcaatgagcagtatagagaatttctggaagggagacacaagaagctgttagaaagggcggcttccagggaagttctagggagtctgggatgaatgagaaacttatcctaacaacttttgggctctctgaattttttttagtatctgcaagtattgtacttgttcaaatatgtttaaggctgcaggctgtattctaaactccttgaaagtgagaaccaggtttcactcatatttccatcttttcaacccctagatcagtgacttcccagggaagtagtacctgcatttggggttgacctttgggtttcccctgtactggtctggcctggcctggctggaccactggctggctgggtggctgtgacctagccccttctttctctttgctcctctgtcaaatgagagtgttggtctgaacgatctctaaagcctggaagaggagcagatcctctgtgctcagcccccactctgtg

SEQ ID NO: 337298 - DNA, 865 bp, Homo sapiens
ctcccaaagtgctgagattacagggcatgagccaccacgcctgaccaggaaaattttaaggtacagtgcttcaaccctgtacacgactaggcctccaggagttttcaacttggtcaaggtaggactggctggctcccaagtcagtcagcccagtcagactgggctgcatattttgtgccccaaagcatagctgactattgatattcaactagcagctgtcttaaggtttctaaaagaacaagaaaataaccaggaactagtgagacaagccagtatatatcacgtcttatcttctgtcattggagagttattcaatatgtctcatcctcagtttctttatatgaaaaatgaaaatgcagagtggctataaggattctattaaatatgaagtgctcacacagagatggcttcaataaataatattttagctatttttagaaatcacttagaaagtccattttccctccacaaattgtctagcaaacacaactgatttttctaccaaatagaccaccttttttgacaaactgaatggtgcattttaatatcatataccttcactgcatttgcaaaggcatttcatcccctatcttaggcaatttggtattatttgtacttatctgataaaatgatttctgattttaaaaatctagatatggctgcagagtggtagatgaattaaaattttaatttcagtagatgactccttcccaggccccaggaaagggccctaagggaaggaccatgactctcctttttcccagatgaatcccaagtgcctggcgcacagttacctccataacgggtgcgcggtgcacatttgggatggttgtatcatttcttagaggataccgtgaggaatcac

SEQ ID NO: 337299 - DNA, 308 bp, Homo sapiens
atatattgccttaattcatagaaacaattattaaactatttcacaatactctaattgaagaatttgatggtcttgttttctacatgcaaaacactgtgccctattgcaatgctaatggattttaaacattttattcatgttgaaagtattttttcacgaatggtatcatttagaatttccttattcacaggtcgctcctctgttatctttcttatttttgtatgccttgaagcaataggatggtggtggctcacacctgtaatcccaacaattggggcagccaaggtgggaggatctcttgagcccag

SEQ ID NO: 337300 - DNA, 535 bp, Homo sapiens
tctcatctggcaatcctgcatatttcccatctaaaagtcccagctgggatctcactaattgggcctctttaacccactttcagcaatatgctaaatgaaacttaaggagaaaatttcaaaactgataagaaacatattgatatagtgtctggtgggggccatgggagttgagataggccatctggatgcttatattcgtaaaatgttttgtttggtggaaataattcacctaactcacaagctgtacaaatattaagatcaaaagtcctaacttgcacaggctgtcaggaaaacctgtggtacaggaaacagagactgtctaaccaagccaaaatgtttctatgtacccagtgcaggtcttgactgccctggtatccctccatacttaacggtctgtaccagtacttctggccaagaaaatacattcatgatataggtttacttacagagcatttgcaaatgcttttgcttgttttccctttaccatttcgaagtaaataatacctccatctcacaaatgagaaacttggtatag

SEQ ID NO: 337301 - DNA, 384 bp, Homo sapiens
ctatctattaagctttttcacttgtccattctattttccacacccagtgtttccaattggttttcttctctaactgcctgttgctgcttcatgtttccagcatcctccgtttctctctgagtttatgatgcttattttgctttctaattgtttaacatggtgttctttgccgcgtgtgctgatcagtttattgctcctcttccacagtactcgtgcgcctcccatttctcattccttttctcctatgagtccatattcccttggacttgctcatgtccccatggaaagggcaaaagcccagcccttggcctgcgtccctccaagtgagcctgccatgacagtgggggaggcagagagcctctagcattcttatcccagccctat

SEQ ID NO: 337302 - DNA, 170 bp, Homo sapiens
actcccaggctccaaataaacccctcacacacggctaaccccatgtccatgtcattttccctttctccaaatcctaatcctaccttccgagtagttgggattacaggtgcaatacttgggtgcctgtaatcccaactattcgaggtctgtagagaaagctgcctatgcca

SEQ ID NO: 337303 - DNA, 81 bp, Homo sapiens
aatggtgatacattctaagaaatgtgtcatcagacaatttcagcattgtgttaacattataaagtatagttacataaacct

SEQ ID NO: 337304 - DNA, 542 bp, Homo sapiens
tccttctgttccagccattcaggactccttgatgttcctcaaacaactcaactgcaggccagtctcagggcattgcattctctggctttgtcattctcgaccaccctgagcagcaattttgatcatcttatatcccctaacctgcattatttcccttcatacagtttgccattatgtgaagttatacaatggacttagttgtctattgattgtcaacagccttgggttgacagcagtattatgacacatatgtaaacagattttgctcattctggtagtctcaaccctaaaacagtgcctggcacacagagtcattatgaatttgaatatttgtttacctcctcaagtcaagacagtaagaaaatagcatgtataatggagactgtccatcccaatccactctccccatcttctgtggtataactgcagcctaacacacatggctagccagacacactccactccccagcctcccttgctgtcagatgtggccatgagcctaggatctcacctaagaaaggtgattaagtaccatgagccac

SEQ ID NO: 337305 - DNA, 416 bp, Homo sapiens
cctgataaatatgtcaggcattatactaggttctttatattcctgacatcatctcattctttgctcaatcaccctgttcgagtaggtggtattatgctcatttttacagatgagaaaactgaacttttttagaatgttagcaccctgctgcaaaccacacaaaattatcataaagtgcacacaagataccatctataaaaaaatgaagattattcctgggaccatattttaagaccagagttatccattgtttacttctgctaattctgaattagcttgtccttgtaatatgacttgataatgtcaccccctcagagcaatttcaagcagtttcctaatcaagcataatgactcaaattatatcctctcttagctgggcatggtggtgcttgcttgtactcaggaggctgaggcca

SEQ ID NO: 337306 - DNA, 150 bp, Homo sapiens
cctgccccagcttcccaaagttctgggattataggcgtgagccaccttgtcaggctgaatagtattttttatagtatgaaagtagcatctgcaaaaccagtcagaatggcgattattaaaaagtcaaaaaaataacaaatgctggcgagg

SEQ ID NO: 337307 - DNA, 454 bp, Homo sapiens
cccaattgaggaaaaacttgaaagcaccaatgtgatagagggaacatgttaatttttttcttatgcattttatagaatccccaaatgccacagaagaagcaacatctagatttctagcacatctcagttaagatgtcacgcagcctcatggtcctggcaacagcttgagccttctctgggcaacacattaaaaatggaagatgatccaagaaagatctgaaattcaaaaggaatgtgagcaaggttcctggtgagtctgtgggtattttcaggaataaagtcaggggcatgttatgttaatgttttatcggtgtgatttttttcccctcatttatttatagtttaattcagccatctgacaaatatttttcagcactgtccaggctctggaagttacaaactaaataattaacttaaacgaacttgtccgtaagcagcttcaagtctggtaggg

SEQ ID NO: 337308 - DNA, 191 bp, Homo sapiens
tccccatgcattcatccagcttctccaacctggcttgtgacctcaacactcaaatggttcttgctggagtcaccaatggcctccatgtcactaaatccaaaggacaatcttttggtccttaccctccatctcctctccacaacatataacactgctgatcaagccttccctctcaaaatgctcccttccca

SEQ ID NO: 337309 - DNA, 211 bp, Homo sapiens
ggaagagggaggacaaacaactaccaaagccctccagcatcacctgttggcatcacgcaatttgataaagtccatgataaaccataaaaagatagcagattggatagtaatatagctaattgtatgtatgtatgtatgtgtgtattttgagatggtgtctcattcactctgttgcccagggtgtgcagtgacgcaatcttggctcaatgca

SEQ ID NO: 337310 - DNA, 106 bp, Homo sapiens
tcatatggacactttgagtcttgtaagtgatcattttccctctttgtgttgctactctaaagcttagaattaaatttgtggcccacccacagcaagggtacaggca

SEQ ID NO: 337311 - DNA, 836 bp, Homo sapiens
  misc_feature (386)..(386): n is a, c, g, or t
  misc_feature (400)..(400): n is a, c, g, or t
  misc_feature (403)..(403): n is a, c, g, or t
  misc_feature (414)..(414): n is a, c, g, or t
  misc_feature (417)..(417): n is a, c, g, or t
  misc_feature (428)..(428): n is a, c, g, or t
  misc_feature (457)..(457): n is a, c, g, or t
  misc_feature (482)..(482): n is a, c, g, or t
  misc_feature (488)..(488): n is a, c, g, or t
gaaactgtagctaactaccaacatttataaataattttatatatacgtagataaccaaactacaaagtttctgttttgagactaatgttgaatacaaataagtacttgagctatcagttaggttttagaaatgtttgagactttgagaaactattttgtaaatcagtgtaagtgttccattgatgttattaaacttttgtaaatgtgcactctaaattgtagttacatgttgttcagactctgttggaaattttaataactcaaagaatgaacatacatatgtacacaatttcttttgagactgttagcaaatttcagttgttggtaaaaaaaagattgcaaacaggacaatattaccatttttatccctgaaaaaaccatgtgangaaccgaacaagtnaantgtgagctcanaanagtgaacattntttaattctgaaattctgtaactgtattnggaagcctctcaccagtgggaagangctttngatggaactcctattttaaatcagataatgtgaattccgtatagaaatgacacttgatgaggcctacaatttgcagcatccaaatttggccaacatttcaagcacttataagcagtttatcattgatgacttcatcttgtaacacattttcggccacaggataatttcagaactatacgttccacacctgcatgcacctactacacttcttcgggggctgttatactttaacggggacattccactcccacctagcatccactggcgatcatccccactccagcaaactcgggcattgctatctttgtaatctctaacacctgggcacacgaatatcttccgcacgaa

SEQ ID NO: 337312 - DNA, 547 bp, Homo sapiens
cctcagtttcctcagctacaaaatgggagagtaacaccaactttgcagggttgttgtgtggaataaattaggtattatatggacaacctgactagcctagagctgaggacacagtaggtgctcaataaattacaggctcctgcctagagaggcagtgtagcgtcagtgtgggctctggagccagatccttgagtgcgaatcctaactctgccacataacagctgtgtgaccttggacaagttacttaaccactatgaacctcagcttcctcatctataaaatggggatagcagtgctgacctctgagggttaaatgagttcattggtgtaaagtgcttaacattcaccatgagcatttcttggccttcccttctcttccttcctttcttccttcctctgtaggtgcctgaggactgagacaagactcctaggtggaagttgtgagaaggtagaaacgatgggacaaacacagctgcccaagagtaaagcaacctaggcagggcatggtggctcatgcctataatcccagcactctgggaggctgagg

SEQ ID NO: 337313 - DNA, 143 bp, Homo sapiens
caggaggtgagggaggtgagcagatgattattaggggcattgctctggagtttcaatgttaagagccgttggaagacatggaaggttttcagcaggagtcaaatgtaggggcagagcaggccatcagctcatcaggcaacagc

SEQ ID NO: 337314 - DNA, 865 bp, Homo sapiens
catattagagagaattcttaccaatgtgaagaatgtggcaaagcttttaaatggttctcaacccttactagacacaagagaattcatactggagagaaacccttcaaatgtgaagaatgtggcaaagctttaaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaaatggctcccagcattttgggaggctgaggtgggtggatcacaaggtcaagagatcgagaccatcctggccaacatggtgaaaccctgtctctactaaaaatacaaaaattatctgggtgtggtggcacgtgcctgtattcccatctactcgggaggcttaggcaggataat

SEQ ID NO: 337315 - DNA, 189 bp, Homo sapiens
cttttagccagtcatcaatccttactacacataagagaattcacactggagagaaaccctacaaatgtgaagaatgtggcaaaggcttttaaccgatcctcaaatcttactaaacataagataattcatacaggagagaaatcttacaaatgtgaagaatgtggtaaagcctttaaccaatcctcaact

SEQ ID NO: 337316 - DNA, 324 bp, Homo sapiens
ccactgcccctcacctgtctatgatattttctatttctgtatcgatgttctgcattttgttgagacattgttctccttgtatcctttaactctttattcatcgtttcttttagctttttgagcagatttcagacagctgatttaaagtctttgtctagtactttcaatgtctgtgcttccttaaagacaatttgtttcttttgtgaatgggctgtactctcttatgtcactgcatggtttgtaatttttttttgaaaattggagtcaggcacagtgattcacatctataataccttttccccccaaaaagaaaaaagtaaaatt

SEQ ID NO: 337317 - DNA, 462 bp, Homo sapiens
atattattttttaaagaagaaaagtatcctcaatgcctactttgtgacaggcactggggaactcatgtctaagggaagaaagtcctcaagtttcaaggggttaggcttgaccctctcaaccactgtctgctgctgaattaacctcagccactcacagatactcattcaacaaacatctccccactcctctgtggggtcagcctggagtctcagaggaagccaggtcctggaggggacgtgggctgtttgtgtctgtccggcatcccatcccgcttagtaaacgacaccccgattttcaccaggggaaccaatctctccgcaagcggtcttggaggagctgtcaatcaagatgcacctccctccaggccaaaggggcgggcctaagacctaaactgggccaatcggatgctctcctggagcggattcctcccagcctgggaatctgaagggtggtccattcat

SEQ ID NO: 337318 - DNA, 298 bp, Homo sapiens
ctatttcagccagtgccaggattttattttccacccctttattaaaaaacaacatactgtgccattttgggtgcttctaaatgtgggtctaccctcaatggctcattaacaacatttctcaattcaacttcatccgctagtctctgcagtggtttgacatcagttacatttctgtcttaagtctgacccaataaaagtcatctcttcccagcttatctttaccttctctcaagtgtgaatataagatttatcagttattaagctgtttatttttttaaaggtatctagctttgtgtca

SEQ ID NO: 337319 - DNA, 577 bp, Homo sapiens
cagatgagtaaacatcctaactatggcagagcctagaattaaagctagaagcagtaggtatactgaatcttgggttttacaagcccttacatatttgttttatttttttatcatttccaacaaaataccatgaaggaaaaccctaagataagtaatataatagctaacaacaattaagtgtctatgatgtatctcagtgccttatgtttattatatctcatcatgtcttatagccctccaaagcaaataagatattcttcattattaggatgaaaaaactgaggcaaaaagaatttgcctgtggtcacacagctatgaagcagtagattttcgagctctgatttttgacctcatgttcttttaaagattttctttgtgttctcctatcctcagacaatttcagattctcctcgctgacaacatggatgtactgtcttcattgatctagtaaagaaaaattacagtgtgtattacctctgatctgttcatgtatggttttaacagttaggatttcagttactgtttacttcatggcgttccacaacagcagcaccatacagatgaaactcgagaacag

SEQ ID NO: 337320 - DNA, 342 bp, Homo sapiens
  misc_feature (40)..(41): n is a, c, g, or t
  misc_feature (43)..(43): n is a, c, g, or t
  misc_feature (52)..(52): n is a, c, g, or t
tcgcccccgcctccccccccccccccgcctaccccagagnnanttttagggnaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337321 - DNA, 360 bp, Homo sapiens
taacaccatatcacacatataacacacccgctaaaaaaaaataaaaagtccaggcatatcctgggcccaaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337322 - DNA, 356 bp, Homo sapiens
  misc_feature (44)..(44): n is a, c, g, or t
  misc_feature (46)..(46): n is a, c, g, or t
  misc_feature (65)..(66): n is a, c, g, or t
ttaatcattgtacccacctcctcttgattcgccgccccgaaggnanccttgagcggtagaccttnnaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337323 - DNA, 349 bp, Homo sapiens
agtcttaaccgttcaactccctacactcctctcagtctaccccttttgaaaagctcatgaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337324 - DNA, 344 bp, Homo sapiens
acgtttttccccattcgtttattttcaaccccgataatcttcgaggcacaaccaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337325 - DNA, 343 bp, Homo sapiens
  misc_feature (15)..(15): n is a, c, g, or t
ctccttccccctccnctctcaccctgttatgtccaccgacaataaaagaactgaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337326 - DNA, 342 bp, Homo sapiens
  misc_feature (44)..(44): n is a, c, g, or t
ttcatgtactttacctcaagccacatagatttcttccctgtggnaagctttaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337327 - DNA, 347 bp, Homo sapiens
  misc_feature (44)..(45): n is a, c, g, or t
  misc_feature (48)..(49): n is a, c, g, or t
gcaaatatatcatattactactgcttttatttttttatattttnnttnnaattttcgaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttatgtcctctagttttccctggttttccttacaaagaataataattctgttctgtcctctc

SEQ ID NO: 337328 - DNA, 282 bp, Homo sapiens
  misc_feature (47)..(48): n is a, c, g, or t
cttgaatgcagcacccccacctccccttaataccggctcagagaggnngttaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337329 - DNA, 287 bp, Homo sapiens
cctcatgccacacctccactccccgctccctccgcacaacaaagaggaagcctcgaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337330 - DNA, 291 bp, Homo sapiens
ccctaaccccaatctctcccccagatatccagccccagagaaagagcttggagcgctaaaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337331 - DNA, 290 bp, Homo sapiens
  misc_feature (49)..(50): n is a, c, g, or t
aaaattgcagaaacttatactatttctccacagcacaagacaacaggannttttagcggaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337332 - DNA, 288 bp, Homo sapiens
  misc_feature (44)..(45): n is a, c, g, or t
  misc_feature (48)..(49): n is a, c, g, or t
gcaaatatatcatattactactgcttttatttttttatattttnnttnnaattttcgaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337333 - DNA, 285 bp, Homo sapiens
tgtaggaaagaaacggtactacactcaatcgcaccaccccgagagaaacctggaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337334 - DNA, 284 bp, Homo sapiens
gtccattctcggtccccactttagaataccagggagaagagggaaggccttgaaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggtta

SEQ ID NO: 337335 - DNA, 314 bp, Homo sapiens
  misc_feature (40)..(41): n is a, c, g, or t
  misc_feature (43)..(43): n is a, c, g, or t
  misc_feature (52)..(52): n is a, c, g, or t
  misc_feature (306)..(306): n is a, c, g, or t
tcgcccccgcctccccccccccccccgcctaccccagagnnanttttagggnaggcactgccattcctcagcctattccagacagagcagaagagagaaaagaagaaataaagcaaaagaaacaagagagagtaaaagaagctcccatggtttttctctgagaatttcactggggatctaattttaaagaaggggacatgaagattgaagaaagaacacataatttcaaccattttgttaaatgaaatttgttggctctataaaaacgcttctgttttggttaaaaaaaaaaaggggtggcctcgntggcctca

SEQ ID NO: 337336 - DNA, 3407 bp, Homo sapiens
  misc_feature (3397)..(3397): n is a, c, g, or t
tgctaatagttgattagtttaattgcttcaatgagaacataaagcattaaacacagtaaactactctggagcaatagtaaggtgtactccttgagatacatcgtaattctgacttgaatttcattgctgatggagattctgagtttatgttacatttctttttcgaaagtgaatgtacactgactagcccttaaaaaaaagaaaaaaagcagccgggcgtggtggcacacgcctgtaatcccagcactttgggaggccaaggcgggcattatcacttgaggtcaggagttcaagaccagcttggccaacatggtgaaaccccatctctactaaaaatacaaaaattagtctggcttgatggtacacacctgtaatcccagctactccggaggctgaggcaggagaatcgcttgagcccaggagttgaagaccagcctaggcacagcaagaccccatctcaagagaaagaaagagagagagagagaaagggaggaagggagagaaaaagagaaaggaaggaagagagggaaggagggaaggagggagggagggacacaaacattgttctgagtttggcctcatgcccagaaacgtcaggatagttttgaaattcatggacttgtccccacatattgatgtagctcactttcttgaaggatattgcttgctttcaattcaatctgttcctcaggagattgaaccatactgatagactaagtgtgtgatgattcagaaatataccaaggtttgcattcatttgttcattgagcaaatatcctgaatgcctaccatgtataggtactatcctaggcactaaagatacagtagtgaaccaaacaaaaacctctgcccttgtggagcttacattgtaggaagaggagaaggacattatataataaataaattataagctatgttaaaaaatgagaaatgacacagaaaaaatagaatatgagacattgggagtgggtttggggagataattagtgttgcagtttcaaatggggattctctcatctgagaggcaattgaagtaaatggggttgacagaataggcttcaatgaaaagttgagattaattaagcagagatttagatatgtgcatagctcaatctctcacctaacagagggtgagagattgatctgtgcatatatctgggaaaagggcatttccatagcagtggcccataggaaggagcatgcatagtgagaaaggaagcaaggcctgcagcttatgtagggcttaatgggtcattgaaaggatttcattcttagtcaaatgggaaccactgtgaaagaaaacacagaaactccaagtatgattcatacacatcaaaatctatgaaccctacccctagggcccagattgtggcctctaaataccacttaccactaaaaggaaacagatctgagacaggaaatgtacaagatgagcttgttgtacgttgctataacaggtagcaagactgctggagttgtgttagaagaactcaggaggccaagcacggtggctcacgcctgtaatcccagcaaggattacaaaacaggcagatcacttcaggtcaggagtttgagaccagcctggccaacgtggtgaaaccccatctctactaaaaatacaaaaattagctgggcatggcgacgggtgcctgtaatcccagctactcaggaggctgagacaggagaattgcttgaacccgggaagcggaggttgcagtgagctgagatctcgccactgcactccagcctgggtgacagagggagatccatctcaaaaaaaaaaggaactcaggagtaaacttggagagtctctcactttccaaagatagaaaatttgactattattgaggtgtaatagagaaaaaatagagaaaaagacatgtcttcaaatctatgaattcagaatgatactttaaaaaactgaatttaatataagtgttaaaggatgctaatcatcagtttcagaactgcaaataaagggactttccaataccaactgtactgacataaccaaataaaaggtgataaaaagtttgtctttattgatatattccagttaacaatgaaaaaagattggcataattagaagatcatcattttgcaacattctaatgaattaatgtataggcaataaatatcaatgactgctaacatccaaaaaagaggtgataagatattatatgtccctgaagaaagaatttgcctctgcctatttcagactcttgtctgaaaacaacaaaaatgaatatgaatttgataaagcctctggatataattactaatttatagattacaaagacatatgttaaactacattacaaagatacaatcagcaaaatccagactatggaaaactctacaaatgatttctataacaaataaattgcaaggaaagaaaccaaccaaacgagatgaatgggtaacctacaaatcaagaaactgaaaagatatatcaacattctcaatgtttgcatcccagttggattctcattcaatattgttttaaaaaatgaatttatgagatatatgtttaaacacaggctatttcatgtattaaaaaataattgggactttgttagatgtgataatggcattgtggctctttttgttgttcaagaggctgtatcttttagacaaatatactgagttatttatggatgaaatgatttgatgtctgagatttgttgcaaaataatacagaaaacaaaggaagtggttgaagggtagagatgaaacaagattagcctgaagttgataattgttaatgttggatgatgggctctttggagtttattatactctttctctatttttgtacatgtttgaaatttatagaataaaatttttttaatctgtgaattttttaagttgatttaatttctaacaaaagatattgtgtttcttcataatttggttttattgtgttgtggctagtgctgtaacagaacagggccgtttcctgctgccagaaacgtagcccacctgtccatatagatatataatgtcttcatgattccacagtgctctcatatgttctctttgtgattaaattcagggtattccagtcagagcatatgctttagagatactttacatgcattaaatgaaataatgcaggccagatgaggtggctcatgcctataattccagcactctgggaggccgaggtgggcagatcaccaaatgtcaggagttcaagtccagcctggccaacatggtgaaaccccatctctactaaaaatctaaaaatacaaaaaatagccaggcgtggtggcaggtgccagtaatcccagctactcgggaggctgaggcaggagaaacacttgaacccaggaggtggaggttgcagtgagcctagatcgcgccattgcacttcaatctgggtgacagatggagnctacatatat

SEQ ID NO: 337337 - DNA, 276 bp, Homo sapiens
taaaactctataaataatagtcagtgacaaccttgtgactaatttggatgtcctggacataaaatacgatctcagtatgttccctaattcagaattgctagaacagcagaccagttaattatttaatatagggagcactaaagcttcctgttaaattcccttgctctctatgggattagcacatgcaggcaggagttctataatgcttaatccctgaagctaccctgaagttagcattttcacatgtattccttccctaaacctttttcttcctct

SEQ ID NO: 337338 - DNA, 182 bp, Homo sapiens
gaacattcatagtaacattgtttgaaatggcaaaaaatttgaaacaaaccatttgtccacggactggagaaatggataaatatgctgtgttataatcccacaatggagcactattcagcaatggaaaaagaatgatctacaagtatcaattcatgttgagtgaaaaatgcaaattggagaat

SEQ ID NO: 337339 - DNA, 262 bp, Homo sapiens
tgtgatgagaataaatttgactgaacctttaaaagagtttttacttgttgggtcagatctttctgctaaatccctcagtgtcaaaatgctgttttgcctttcctacctacatattactttgatatcacctcctgtccaatctgatttaacagcggtcctttgtaggccaaaatttcctttcaaggcaggaggctttgtcaactgctgttaatttttttttaaaatgttccccatatcattcctgaacctcagaacattttgg

SEQ ID NO: 337340 - DNA, 345 bp, Homo sapiens
tccctagtggatactgagggatgactcctggatatgctatcaaggcagtatctcagaatcctttaaacgggctggaagacagctttaccagtctaatgaatcacctcttctttatggctccttctgagcgtatcccaaaccagagaggtcagcagtgctgggcgattcttaacaggatatttatgtcctgttaacatgcagcatttctgggcagccttatgggctccactgtttcctcctggccaagaaatacaaaatcacctgggcaaagctgggcttaattgaggttggctgtgtgggctcgtaagccagtgtctctttgcatcgagaggagtttcatttgct

SEQ ID NO: 337341 - DNA, 202 bp, Homo sapiens
atggagggcgagggggtcccgtagatggagggcgagggggtcccgtagatggagggtgagggagtcctgtagatcaaagctgcaatggctccatgaaggctgccacgtggaggtggtaaccaaggcagggacaatggcctggacagcgctatggacggctgaacaacagctcaaggagcagaatgttcacagcataacacac

SEQ ID NO: 337342 - DNA, 467 bp, Homo sapiens
gctggctcccactctgctctctatcccccaaaaatccacagtcctcccacatgtaagtacattcaccccctcccaaggaacaagacagtcccatcagctcacagcatcagctgaagagttcatcttatctatgttaggtccaggggcggatgacgaccctagggttctcaggtacagctctaagacagttcttcctgatctgcaaggctgagaactagacaagttatcgccctccaaacacccagcatgcaatggtgggacagttacatgatgcccagatgctcctgttcagaaaggctgcaaatgaaaggcacacacactgctggtccataagcagttctgaaattcagctgggtaagcactggaacccagtgatactcctgccaggaaatgactttccagacggtttgactctgccctgggaggacttgatttcatcttaggagtcatacttttacatgaaaggt

SEQ ID NO: 337343 - DNA, 344 bp, Homo sapiens
atggaaatatgtttgtggctgtggacaaggacccagggtgtctcatggtggatgtaacattagacagagactctctctagcctctgactgctctgcctgatcagtccttcctgtgccagtcccaggccattcaggttctccactagcctttggagatggctgaggcccagatggaagaaaggggacctgcccttctgctctcctcagttccttgccccagggttgggttctacttccagaatccctcaaaacattttgcacaaaactcccaggtaatccaaatcaggaccacctctcagagcagtcttcctggatgtcgaccctggcctgggttggataggaat

SEQ ID NO: 337344 - DNA, 581 bp, Homo sapiens
ggctggagcagattcctcctcacagtcccagaaggaaccctcccacaccttgatctcacacttctggcctccagaactgtgagagaatatatttacattgttcaagacacccagtatgcacttatgcactttgttacagcagcccaggaaactcatacagatacataaactagcatgtcacttaagctctctgtgactcagtttactcgtctgaaaaaaaatggacctgaaaaaatagtcctgttctcataggcttgttgtgggatgaaaggaaacaagggggctggtgtggcatctacctctagaagctggtacttagcatggtggctactgccactaccccatggcctgaccccaaaagaccccatgccttgaattcacacccacatcactgggctcactgcctccagccccatcagggtctgagcagccaatgacttctcatgggtggggagagggaggacgtggttgtgtcagaggcgtttgaaccaaagcaactccatcttgaataggggctaggtaaaatgaggctgagacctactgggctgtattcccagatggttaggcattctaagtcacag

SEQ ID NO: 337345 - DNA, 510 bp, Homo sapiens
tagcgggggtgcatccgggtacggacgcgagagcgattgtctccgtcactggagttgtaggcgagagtgtgatttgggattaccagaaaacagaaagggcaggactggaaaacgtctacctccacagttccctaatcccaggagcccccatccttgatcccagccaacaggctcgcagggagtacacctgctcgacatgtggtttagagccaaagaagtcctccagtcaggctggtggcaggaggggtagggagagaaaggggtgaggggaggaagctcctgtgcctaccgatacagaaggctgatgtgcgcctgatgtccaggtaagaactgatgttaacataagagcatcattacacaatgttccacatagagccagtgaatgacaatgaacaaataccccttttcattcttacagacccaatattagaataccactgtatgtgtaaatcaaacgtttcactgtgcctggcctaagttccttaacacaaagtttaatatatctcccac

SEQ ID NO: 337346 - DNA, 225 bp, Homo sapiens
agttaaaaccaaaaccttctggcttacaagggcttacacaatctcctactgttcttgtttagtctgctttagctacactggcctccttgctattctcgtgaacactccaagcatgccctgtctcagagcctttgcacttggctctccttgaaatgctcttccttgagatacctgtaaaactagcttccatcctcacttgttccaagtcttggtcacttttcctag

SEQ ID NO: 337347 - DNA, 504 bp, Homo sapiens
tttagagaaagaactatgtcttaactctgaattctagcttagggctgtgtaccacgtacaattaataaatttttaaatgaatgaactaataaaaccaaccaactaatcaatccaactaaaaagggtattaataatgtcaccacagaacctagaccatttgatgcttaacacctcacagtagtccagagtgtccaagatggggtgtgtatacaagatgattataagtggtatatggacaaactttttttaagtttttaatacttttatattacttaatgtatagaagaacaaagccagctactaacctcattattaccaatctcactgattagatcaatactaaagaagttacgttttttgtatgcttttagtattgttttatagcaggtagaagtttaaggagaggcggggcttggtggctcatgcctgtaattccaacaatctgagaggccaagacaggaagatcgcttgagctcaggagtttgagaccagcctgggcaacat

SEQ ID NO: 337348 - DNA, 486 bp, Homo sapiens
atctttgttaaatctaacaacctggctgactctgtaagttagtttcattgaacactattttttctgagtacaggctgcagggtagattttcctgtttctttgtatactttgtataaaaggtgtttgaatataatctctgcccaatcgctggttgatcactgagctgagaaaacacagggatgacccctaggaagccaggctgaaaatataaatataagaatacaagaactgagcaaagaaataagtagctacacaaagcagagaagaactgaattctttaaacaggaagataacagacataatacacagaaagaaagaatacagagacatatttgataaatgttactatagcagcctagaggagaccatcaccagaaagcccagttagatcaccaggggagcttcagaggagacttggaactttagctgtgcttaacaccaacctcaactatgcatgctgagatacataaattaaggtgtcaaatg

SEQ ID NO: 337349 - DNA, 211 bp, Homo sapiens
ctcatcaggcacagcagaggtccctgccccatttcttggggtcccctaagccatagacatggggcagaaagtgcttggcagtaagtgtacagggaacacattaaaactgggcagaagtttggacagcagtgaacacagtgcacctcccaagtggtgagaggggacactactatgggctagaattcacagggaataatgaatagtgagtccc

SEQ ID NO: 337350 - DNA, 94 bp, Homo sapiens
gtaaatgtcaagaaatctaatctttgggcaatgcaacagagtagagcactcactttgaaggggctcagcatctcttcatttagcccttctcaca

SEQ ID NO: 337351 - DNA, 523 bp, Homo sapiens
attaatcatcatccatccattcatccatctaccatccatccatcatctgtccatccatccattcatccatccatcatccatccatcaatgctgtatccattcctccatcaattctccatccatctatccatcgtctatccatcaatcctctgtccattccatctatccatctatcctctatccatccatccatcatccgtctatcctctatccatgaattattcatccatcaatccatcctctattcatccatctatcctctactcatccgtccatcattcacccattcatctacccacccatccatccatccgtccatctgacccatcctggcggtcaatgaggaagtaactgaaggccgtctcatcccatgttccaccatgtaagggggtgactttgttcaggaagaaatccgtgtctccaaccacactatctacccatcacagacccctttcctatcactcaaggccccagtctgtcacaaatggatacatacagttctgtgtactgccaagcatgtgag

SEQ ID NO: 337352 - DNA, 1275 bp, Homo sapiens
caggcaataagcaaacaggagaaactactttcctcacctgttcaacaagaataaaaagtggcaacattctgagactaggacgctgggggaaagagtgaacaggaggggagaactcacccagacagactgtgtgtcagctgtggatgttactccctgtctcagccagaagaattgatgaaattcacacactccaaagaccagcaagtgagaacgggcttctcctccaactggatggctccagttctatacatgaaaccctgacctttagaagcaccactgacggctacttcaacttatacctccgtgtttccagtccatgatgaatttttgggaaagagagctcttttctcacagttgaaaacactggcagcctgcagatgtggaagtctcagctgggaaacatgaaatctttcgatatcccaaaagcacacaccttggaagataaactttacccatgactaactaaagtcattcttaagagaaaattatggagaggattaacatgcttcatccctttctctcagcttcccgattaggaccttctagagttacataaatcacttcttgctctagccagtctgactccaagcatcaacacaccattgttgcctgggcattttttcagcctagccaataaaaactcccaagtcatcctggaacttttggagatgactgagatgcaagaaaaaaaacacggtagactttaacaaactgtacaactggggacaaccagcgggaaggttttggaaggctgggggtaaagaggtggcctgaccataattaagggcaagtcctgccagcaaacccgtgcccattttaagagagggatggcggttttcccaggcgggagctgggtgccagggctcattccatagacaaatgctgtcctctctcccctccttaaaatgaacattgtcaggaacaggaagggcacaggcgtggttctggaaagatctcagttccagtcccagctcatcgtttgtgcctatttcctcatctgtcaaagaaagatatcccaggaccctgcctgtcgcaaaagcaccatgaagataaagtaagatcatggacaaaggactttgtaaagcaatttaaaagttgtatgtgtgctacatgccaggcactgtgctaaaggccatacatgttttaactaaattcttgcggcagtcttctaagggaagtattatttccactgcgcaaaggagaacaccaggattcactggcattgttaatatttgctggaagtttaaaaaaccaaataaatgtctgaaaagtaaa

SEQ ID NO: 337353 - DNA, 1134 bp, Homo sapiens
ttttatatgatgtgtctgtgccccgtgcacatgtttctgtttctatactttttttatgttctagtgagaacgggcttctcctccaactggatggctccagttctatacatgaaaccctgacctttagaagcaccactgacggctacttcaacttatacctccgtgtttccagtccatgatgaatttttgggaaagagagctcttttctcacagttgaaaacactggcagcctgcagatgtggaagtctcagctgggaaacatgaaatctttcgatatcccaaaagcacacaccttggaagataaactttacccatgactaactaaagtcattcttaagagaaaattatggagaggattaacatgcttcatccctttctctcagcttcccgattaggaccttctagagttacataaatcacttcttgctctagccagtctgactccaagcatcaacacaccattgttgcctgggcattttttcagcctagccaataaaaactcccaagtcatcctggaacttttggagatgactgagatgcaagaaaaaaaacacggtagactttaacaaactgtacaactggggacaaccagcgggaaggttttggaaggctgggggtaaagaggtggcctgaccataattaagggcaagtcctgccagcaaacccgtgcccattttaagagagggatggcggttttcccaggcgggagctgggtgccagggctcattccatagacaaatgctgtcctctctcccctccttaaaatgaacattgtcaggaacaggaagggcacaggcgtggttctggaaagatctcagttccagtcccagctcatcgtttgtgcctatttcctcatctgtcaaagaaagatatcccaggaccctgcctgtcgcaaaagcaccatgaagataaagtaagatcatggacaaaggactttgtaaagcaatttaaaagttgtatgtgtgctacatgccaggcactgtgctaaaggccatacatgttttaactaaattcttgcggcagtcttctaagggaagtattatttccactgcgcaaaggagaacaccaggattcactggcattgttaatatttgctggaagtttaaaaaaccaaataaatgtctgaaaagtaaa

SEQ ID NO: 337354 - DNA, 213 bp, Homo sapiens
catgcttctacatttttcatctgattacaggtgagaacgggcttctcctccaactggatggctccagttctatacatgaaaccctgacctttagaagcaccactgacggctacttcaacttatacctccgtgtttccagtccatgatgaatttttgggaaagagagctcttttctcacagttgaaaacactggcagcctgcagatgtggaagt

SEQ ID NO: 337355 - DNA, 359 bp, Homo sapiens
cccacccctcatttgcctcatttgacacctgagatgaagtggcttgccccaaggtcatacagagggtaacaataaagataacactagcaccagaccttccaatcccccttccccagtgcactttctactatcctttccctgaaaacgcagaaggtttaaattttttaaattttagcatctcactaatgtcaatttatatagattttgtcctaggtgctcatgtttcctagacataaagaagcatcattaataatatctttgcttcctttctgttaaaacttaacaagtcaattttctagaagtctttctaggcatgtaagtatagaatttctgatagccaaattcagtttataataaat

SEQ ID NO: 337356 - DNA, 354 bp, Homo sapiens
tatccatcccttgtaacctctgtgcttacacattttacaaaattggttcacattacacgcacactgtatcctcactccacttactagattttaactatctctatgattaaatgttcctccaataatttttgatgttgtaaacaacctatctcactgatgtgccaaaaccatctctctactgcctgacattccttccagttgtttccaatgcttctgccctttgaagaatcgttacaatgaacatgcttgaacagtctgaggctgtgctagctggatgtttcttccagcagattccccaaccttgggtatcagtattcagttaagatatggagacttaagcaaacagctgcctac

SEQ ID NO: 337357 - DNA, 499 bp, Homo sapiens
atgcccagtaaatatctgttgacagagaaaggttgacaggggcagatggatccaggatgactcccaaattcctaacccagtgcaaaagcctggatgatgatcccagtctccattatgagggccccaggaggagaagctggattgcagggaaagatgaatccagaagccatctctctgatctagaggaaacgaggctgtgctgtgtggaagggattaatgttaggggagggtagaaacgccggttccttgggaactggagtgcaggtatgagctgggtgtcagttgggtctgaacatactggctttgctgtaatgcttgaaaaggcgttggtatcttcattttacagttcagttaacccaagtacgtcttcttatttaaagtgacaacttgggtgctttaaaatgaggtaccactttttaaagctagctgtgtcgagttaaagaaaaaatcagcagtttcttctcccagaaatgtagttgccatacactattcatcccca

SEQ ID NO: 337358 - DNA, 477 bp, Homo sapiens
aacagctaaaaaccagaatgttgagggaatggaagggatgctgactaggttgaggcacagctggggctgggagcatggggaagtttctcaggccccaaaaccactccccaagagccaaagagtaacactggcaagggaaacatgaccaatgggatggagttactgactggctcccctcaaggattccaggtcccctgggcttgtcacttccctttacttcccccatgtctcagtaggtaacaccggccaagaaccgcacttgcagcagctgtcggatggattaggcagcacagacagcagcagggtgtgtgatcccaggggacagaagcatctctcagcaagcagccatcttctgcagactctgggatttttcaagagtgagcacactggctacaaaggagtcttcctacgtgaggcctttgtcaaaggaagggctacaaagtgaccattcagctcctggggttgagagcaaagggc

SEQ ID NO: 337359 - DNA, 296 bp, Homo sapiens
tgggatggggctggagaccagcatgggccaccttgaattcctggggccgtcctgctccagcctcctccggaagacttctgtcccccaagctcagctgatggccagccctccgatttcactgaggaaaccaaagcagccaggagagggccacctgccggtcagcacacatgggctgtcacctccccctcaaaaccactacaagacccgttgcttgaccccattttacagcagagttgtgacagctggtcacactcactgtctccatccctgctcacgctcgcccaccaggctggagc

SEQ ID NO: 337360 - DNA, 338 bp, Homo sapiens
cctcagatgattatatataaaattctcaagttactttcagggggaaaaatagaaaaagtcaatccagttattcttggtaaattttgcacataatgatttaagagggctaaactagataaatatcttgagattaagaaatattatttggccgggcgtggtggctcacgcctgtaatcccagcactttgggaggccgaggcgggtggatcatgaggtcaggagatcgagaccatcctggctaacacagtgaaaccccgtgtctactaaaaatacaaaaaattagccgggagcggtggcgggctcctgtagtcccagctacttgagaggctgaggcaggag

SEQ ID NO: 337361 - DNA, 167 bp, Homo sapiens
ctctgagaaaagactcctctatattatttagcttcccattgtgactttttggaaaattgtacaatattgtccttgtacagtattaatattccatattcagtagaaactgtccatgtagccataagagtggatcaggggagctaggactgtctgtagcgattgtcaga

SEQ ID NO: 337362 - DNA, 482 bp, Homo sapiens
gatttccagctatgagtataagtctgggctactactttgccatcgtggggagacaggctatgtagttataaagacaagcagatgcaaatagaagcaggagttggaggaagaaaagaagcgatcttgctgatacggtctgaatccttggttaaagcaagcctaaagccaaccagcccttgaaagtcttagcttcatgattcaagaaatttcctttattggcttaaatcatttgaattaagtttctgctccttgcactgaaagcattctgacaaatagatggaatgtctactgtatgaggcactgcgttgggtgcacataactggaggctgaagtttaagtatagtggtgactaaattccaaagataactcctaatgaaacatgcctcccgtcattcatgcctctatttagtcctctcctacattaaatctgggctagccctgtgacttgctttaagaaagtgacagaagtgatactatgctcg

SEQ ID NO: 337363 - DNA, 247 bp, Homo sapiens
aagaggatataggttgtttgggtagtttgacatcatcttctatatgccagagaaaagcaggaggttcaggtacaggtttcaggagaatgtcggttaagacaaatccaactatgaatggaagagcaattgatatttttcttgccctgggagttagatatagtgatgtcttctgctgtttttgggctttctttttttttttttttttttggaagtggaactcaatattttaatgattttacttaagata

SEQ ID NO: 337364 - DNA, 1299 bp, Homo sapiens
gaaaggagacacgaagaaggcaggcaatatcagcctgaaattgcacagccggcaagtgttggagacaggtttccactcacacagtgtgactcacagacactgcagtctacaacaccagtctccaagctattctgcctacttcacctacagaggttgggagttgggagatgagaacagtaatttgttatagaattggtttgccaagatatttggggagaagaatacaatgatatgttcacaaaacatttttatcactatgtgctctatttgtcaacgcactacagagaggagatcaattcagaaaaagaattcatcactttgcaataaagaaataaaagaatccaacttttttgaactttaagtgttgaaggaggcatctttcttattcccaactatttgaaaccaaaactgagaaaaactttgatcaataaaagcagattgaagcccgtccttgtgtggagaatcaaattaaaaggatgatcaatatgcttgctatccaaaagctttaagatgcttcacagtaaaagtccatctaagtgtgtggaatgaagtgtattctttcaattggacaaaattgctcagtgaaaagaggacaaagttatggctatatcacaattattgacaaatttaaagtactgacaattaattttagagagggcaaaatgactagattaaattggcagttctaggaagggggagatccagcattcagacaggcagtctgctcaacatgcgttctagtgaagtttcaaaagtaaaccacataccaaccattatgcatgctatcatagaaagaatgaaggttgtattacatctaatttcacatcaacaacatcatttggcaaaagagaataaaataatggtttcagaattgtaagcaaaagaaattctggatctaaaatttggtattccatcaaatgtccaccaagaggataaaagaaatattttcggatatactaagactcagaagttttatttctttcacaatgttgcttaatgaaaaagtcaaaagagaatgcattctggaagagaaaagaaacaatcaagaagaaaatatgccatccaaaatgcattctacctacttcagagtataaagaataaaagtactatgataaaagctgtgcacctctcctagaaaatgactgtttacattggacaaaagttcacaagtttctgagaataatttttctgtagatcagtaaattttatgaagcccagttaggaatctggatagcagtatgaatgagagatgagcaaattattcttctgtcaacatgaaaaaataaacacaattaataa

SEQ ID NO: 337365 - DNA, 1264 bp, Homo sapiens
gaaaggagacacgaagaaggcaggcaatatcagcctgaaattgcacagccggcaagtgttggagacaggtttccactcacacagtagtctacaacaccagtctccaagctattctgcctacttcacctacagaggttgggagttgggagatgagaacagtaatttgttatatatttggggagaagaatacaatgatatgttcacaaaacatttttatcactatgtgctctatttgtcaacgcactacagagaggagatcaattcagaaaaagaattcatcactttgcaataaagaaataaaagaatccaacttttttgaactttaagtgttgaaggaggcatctttcttattcccaactatttgaaaccaaaactgagaaaaactttgatcaataaaagcagattgaagcccgtccttgtgtggagaatcaaattaaaaggatgatcaatatgcttgctatccaaaagctttaagatgcttcacagtaaaagtccatctaagtgtgtggaatgaagtgtattctttcaattggacaaaattgctcagtgaaaagaggacaaagttatggctatatcacaattattgacaaatttaaagtactgacaattaattttagagagggcaaaatgactagattaaattggcagttctaggaagggggagatccagcattcagacaggcagtctgctcaacatgcgttctagtgaagtttcaaaagtaaaccacataccaaccattatgcatgctatcatagaaagaatgaaggttgtattacatctaatttcacatcaacaacatcatttggcaaaagagaataaaataatggtttcagaattgtaagcaaaagaaattctggatctaaaatttggtattccatcaaatgtccaccaagaggataaaagaaatattttcggatatactaagactcagaagttttatttctttcacaatgttgcttaatgaaaaagtcaaaagagaatgcattctggaagagaaaagaaacaatcaagaagaaaatatgccatccaaaatgcattctacctacttcagagtataaagaataaaagtactatgataaaagctgtgcacctctcctagaaaatgactgtttacattggacaaaagttcacaagtttctgagaataatttttctgtagatcagtaaattttatgaagcccagttaggaatctggatagcagtatgaatgagagatgagcaaattattcttctgtcaacatgaaaaaataaacacaattaataa

SEQ ID NO: 337366 - DNA, 176 bp, Homo sapiens
ttgtgggggagggacaacaacagatgggcaaagagctgacagaaaagcctaggaaggaagaggctgggaaaagagctacatgaaggtctaagggctttggaaagctcctgttcatgcttggaaatccagaaggccatgcacacagctggggctagacaggggctcagaaacacctg

SEQ ID NO: 337367 - DNA, 346 bp, Homo sapiens
agggggcctgagaagagatactagtcctactcaccttttcagacccagagtgctcaaggccaccttctctgaccacacctttgccactgcggcccagccatgggccttctgttgtccactcccccactaacgacgcacttagcagcacttagcagagatctgcaggaaagctaagtgctttaatgacacttgtgtatcgattcagagctttttttattccccccatgaggatttcccatgtgcggcgcatttgggggcagtgcaaattcttagaggctaagttcccagaggccaggggctactctataaagctctctctgaacacagggagcacaggcctcagcat

SEQ ID NO: 337368 - DNA, 658 bp, Homo sapiens
tcgttatctgtctaatctgcacatgcttgtgatttttttttatgacgactctgatgccctcatttctcattgcagctcagtgcttgtgatgtttttttcccctgaatgcatcttgcactcccagaatcttcttttcattcttccctggctctgttaatacgggtcttatcttagaacggggtctagtgcagtttagtgtagctcttacatgcagagcattttttttttgcacaaactgcttctcgtggattgtgattcagttgcacttaaagggaaaaatagagtatattttaggctactaaacctccttccatttgtaggcatttgagccagttatacagtgtctttcagggagttttacatgcatatgttaataaccagtggcacctgtgataggtccaggaatgtgaaattgtgcaacgttaatgacatttgtccaagcttcttccttctatcttgtcaatatgagctacttttaaatacacaaaggaattttgaaaacaccaatcaaaagtcaaaatttcaccctgcagcatggcccggcacccagaacactcagcaagaggaaggtctgtatttatggcttttccactgacttgaaatttgacctggaataaatcatgtttaacttctttatgcttcaattagcttttgaaag

SEQ ID NO: 337369 - DNA, 414 bp, Homo sapiens
agaaagcatgggtatctctaagggaatacagtataaatcttagtatttcaggaatgtataaaatatgtaaagaaaaactttttttcctagttaaatattttttatatctttcagctgagtatttagatatatactataaattagtattttcaccttatttactctttatcaggcttgaatttggcataatgtatttctattacatattttataatcccatgcagtaatataaactactcaatatattagctttgcagagttccacttttttgtgttttgctgaaacatagattatctcctcagtttttcacgcataggaattagtatttgggtcactttttcagtccctatctaaatccggtacatagatacgagttttccttaaataagtataaagcgattcatttaaaataa

SEQ ID NO: 337370 - DNA, 3280 bp, Homo sapiens
tggatatgggactcctgtttgtggcctgcctctcttccgagtcttccagtgcagtccagataacgatctctgagagtctcttgagaccactgaagcaagaggcttcaaggtttgttctaggcttctctagttggcaggtcttccccgatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctcgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagagaaactttgcgtctcagtgtttgtgttgctataaaggaataactgaggctgggtagtttaaaagaaaagagctttatttggctcacggctctgcaggctgtacaagaaacagtgagggcttcaggctgcttccacttatgcaggaagatgaagggaggcaacgtgagcagagatcacagggcaagaatgggttgaggggtaggggtaagtgccaggtgccagcctcgttttaacagccagctctggggtgggggagggacatatagagcgagaacttactcattaccccaccaatggaacgaagccattcatgagggatccaaacacctcccattaggccccacctccaacactgggaatccaatttcagcatgaggtttgcagggttgaatatccaaactacatcactttatcagataaatgagtagtcattcaggttgaaaaggtgctcagatacctttaaggagtacattcagattgttcaggttcaggttttttgcaaccattttactgctcattaatacattcattaacttacagataagggaaaggacctaacacttaaatcattctaatatttctgatgaagtgggatattatcccaaaatggaatttttaggtaatcttaaaattacattgatcaagctgggctcggtggctcacatctgtaat

SEQ ID NO: 337371 - DNA, 2520 bp, Homo sapiens
tggatatgggactcctgtttgtggcctgcctctcttccgagtcttccagtgcagtccagataacgatctctgagagtctcttgagaccactgaagcaagaggcttcaaggtttgttctaggcttctctagttggcaggtcttccccgatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctcgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagcccaggaaccaaattacttgctttacctcattgtgtaagacaagcgtcaaaaacagcttcaacctatcttgaacaagagaacttacctccaaaggtgatctgccatagcttacacagaatcataaagtgttatattttcatttgtt

SEQ ID NO: 337372 - DNA, 2414 bp, Homo sapiens
tggatatgggactcctgtttgtggcctgcctctcttccgagtcttccagtgcagtccagataacgatctctgagagtctcttgagaccactgaagcaagaggcttcaaggtttgttctaggcttctctagttggcaggtcttccccgatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctcgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctgggtaatgctctatggccccaccagacaccccccgacacacacacacacatggcccctccttgggcagcagcagccacagggcaccccctgcagtctctagagatggctttgagcccctgctgctcactctcatgttctctctcattcattcattcaacacatatttattgggcctgaagcaggaaaaaaacacgatgccaactgcagtcagataagtaaacagacccttcgtagcagtgtgagaagtgtttgctgagtttaacagagtacagtggcaggagagcacctccccccaggctggaataagctgcccccaaataaattgtactgcatgga

SEQ ID NO: 337373 - DNA, 523 bp, Homo sapiens
caaggaagggcagctctaatgctcctctttgtggctggagccagagaacttgttaagaaggagggtcctgggctccagccctagagctatgacccaggggcctaggatggagcccagaagcatgcaggtttaaccagtaccaggtggctctaatgctggggatctgttcaccatggttggagtactgtgatgagccctccttacccatgccctggaagctgtcctgcccaagggactcatactgacatccacacatttccccaaacagctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacaggttggtccccttgtctcctgtagagtgccctgcctcctgggttgttccctggcctcccatgtgggaaggacatctcc

SEQ ID NO: 337374 - DNA, 3370 bp, Homo sapiens
tggatatgggactcctgtttgtggcctgcctctcttccgagtcttccagtgcagtccagataacgatctctgagagtctcttgagaccactgaagcaagaggcttcaaggtttgttctaggcttctctagttggcaggtcttccccgatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacagggtgagccaagccagcgctcgacagggcttgctggactgtatgcagcccccgcagcatcacctgttttcattaaaggaagtgggatggatgccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctcgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagagaaactttgcgtctcagtgtttgtgttgctataaaggaataactgaggctgggtagtttaaaagaaaagagctttatttggctcacggctctgcaggctgtacaagaaacagtgagggcttcaggctgcttccacttatgcaggaagatgaagggaggcaacgtgagcagagatcacagggcaagaatgggttgaggggtaggggtaagtgccaggtgccagcctcgttttaacagccagctctggggtgggggagggacatatagagcgagaacttactcattaccccaccaatggaacgaagccattcatgagggatccaaacacctcccattaggccccacctccaacactgggaatccaatttcagcatgaggtttgcagggttgaatatccaaactacatcactttatcagataaatgagtagtcattcaggttgaaaaggtgctcagatacctttaaggagtacattcagattgttcaggttcaggttttttgcaaccattttactgctcattaatacattcattaacttacagataagggaaaggacctaacacttaaatcattctaatatttctgatgaagtgggatattatcccaaaatggaatttttaggtaatcttaaaattacattgatcaagctgggctcggtggctcacatctgtaat

SEQ ID NO: 337375 - DNA, 1376 bp, Homo sapiens
tggatatgggactcctgtttgtggcctgcctctcttccgagtcttccagtgcagtccagataacgatctctgagagtctcttgagaccactgaagcaagaggcttcaaggtttgttctaggcttctctagttggcaggtcttccccgatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagaggtaagtttggacctgggccagcctgggctgcatggagactccagacactggagctggggtgcagctctggcagggagcacctgcaccaggcccctgtggcagccctctctaaggacagcaccaacacccagtctgtgccagggctttctccctgaatgaaccagctctcagacccagggtcctgttttggtgtcacccctgggagaagcaggttgagccttcccactgaaagcaaaagcttgtctcaccaccagaccctggtgctggctcaggctattttggtcacaggagttgagactcactgagatgaccctgggaaagctgcccttcattataacagtgcaggggtgagaactggagagggcctcgggaatgaggtggcctgaggatgggcttctctctctctccccggctattctgtttccagagtgcactcaggctttgcaggacctgaagctgatgcaatctgggggaccctctttaaga

SEQ ID NO: 337376 - DNA, 455 bp, Homo sapiens
ggtggtgtctagaggatccctcggtcgcgaatcaggtacaaagcaaagagatgaaaacacctaggctttcccagaaacatgggtgatttttaccatttctgggcgttttttcccctgtaaaatggaaataatatatgtggaaataaagaaagatcgccaaaactggaacgggcagaggctctttattccaagcttggaagggagtcagccaccatcacttgcattttgtcagaggccaaaggcaggcagaggagtgggaaagctttacagtgggaagagggaaggcaccagtatgccttgtatgaagcccgctggtgtgggaaagctgcaggtgggctaagtagaaatggggcatcctgtgcaatttattatgtttggctttctctgatttgtccaaagctggaagtggggacaaaaattagggaggctgtcagttatgaatctagtcctggcca

SEQ ID NO: 337377 - DNA, 214 bp, Homo sapiens
ggtggtgtctagaggatccctcggtcgcgaatcaggtacaaagcaaagagatgaaaacacctaggctttcccagaaacatgggtgatttttaccatttctgggcgttttttcccctgtaaaatggaaataatatatgtggaaataaagagcctctgcccgttccgttttgcgatctttctttattccacagggatcctctagacaccacccaca

SEQ ID NO: 337378 - DNA, 402 bp, Homo sapiens
aatcagttgagcccaggaagttgaggctgtagtgagctgtgattgtcccactagacttcaacctgggcaacagagcaagaccctgtctgaaaaaaaattgtttaatgttataatagcaacaaaaataaaagtgaattttacaataaaataagggcatttgcatacatgaatttttatttggaaactttcatagcccctctgattattcattcattatcctaaagttctttccacagaggttattatcagactgagcccagaacaacttggccacagaatattggtaagggtccataagtgtctgcagatagaattgcccagatcagctgtttaactggttggtctctctagacagaggtttagttacacacatgagttagcccaaccttcactccctatact

SEQ ID NO: 337379 - DNA, 360 bp, Homo sapiens
cattctggagtttgtgtgcagccatgacagggagaagctccttggtttccagtggattccaaggagtccaggagaacttgaactgtgtattctctgaggctttttcagctctagaattatgttttggggtgggtagagcagacctatggccagaaactagagaaaagggaggtggtataatgaggcaaagagggaacttacctggtcaccccatggctagggatgcaccttggggcgcagctcatagggtggggaatcagtgaagggcccctccatgggggtgtgtagggacagtctctataccacaggattagggctactctcacacaggcatctgttcactcagcaaactttctcaag

SEQ ID NO: 337380 - DNA, 423 bp, Homo sapiens
gacaccagccccacctgacagaactgtccgggggtacagtagagagttaaacattcattggaaggagctgaagaaaagactatgtcctttgaggggagcctagtttcagttaagcctggaaggggaaaataaccattccttgaagagatagaggatatagagattacagtggaaaggtttggacagagaagctgtaggaagctgattctagaaagggaacatagaatttggagatagagtatgggagaaggcagataacagatgactgaaaagcttactaaattttgttcttggattgttcttaatgtgaatggtagttacacattttcaattgtttttcttccacagtcagtgggaagacactataagataaatagaggttacaacttaaagttgtatggttgcaagttgtcagaaaaaaaa

SEQ ID NO: 337381 - DNA, 607 bp, Homo sapiens
tgggaggaggggtatggcggaggggaaagagcatctgtgagagagaggggctgccctgaggtcagacagaaggtggtggctcaaaggggaggaaggagagatgtttcacaactgcacatggagagaagctggaggctgctggctggccttgtgactgtgagtctgtttggtttgtccgtggggctgccagggcctgtggcagggatgggggtagaggtagggggtttatgtcaggatccagatgtcagggtgagaatgtttagcatgagctccctctagctgctacatgggagagagccatagttggcaggaagggaggccaggaggccagaagggaggccaggaggcaaccagcaaggtgagggccagaagcagccagcacttggtggaagcttcaggtttctggctttgacagccctgtggacaaaaggcaagggacaggtggggtagggagtaccctccactcccagcaaccctccccacacacagtctgatctccatctctgtggccagaggacacctgtgaacacccgagccagatcccatccctcctttgttcaggattcccaatggctcccacctctctagaaagccaaagtcctccttg

SEQ ID NO: 337382 - DNA, 261 bp, Homo sapiens
tgaacataggatagtcatatgcaaaaggaagaagttggacagttatctaacaccatctacaaaaattaactcaaagtggatcaaacacctaaatataaggcagaaaactataaaactcttagaagaatgcataggggaaatctttatgacattagatttggcagtgatttctttgatataacaacaaaaacacagtcaacaacaaagataaattggagttcattaaaattgaaaacttatggctgggcatggtagttgacg

SEQ ID NO: 337383 - DNA, 401 bp, Homo sapiens
cttatgtctgaccacctaatgttctaacagcaaataattcaactgtaggttgtaagagctataaaaagtggaaagtttggtattgtcagaatgcataactggagacagggcctagtctgaaggaatagtggagagggtgggggtcagtgaaggttggcatgtggaattgacattttagatgaactttaatgtgtaagtgggaattgtcaagtgaatggggggagagaaggaaaatttatggagagtaggcaatgccaagcaaatttggtagagggaatagtctgtccagaggcactgagagtaaaaggggcatatttgcacttgacaaatggaaagaaagcctgtgaatctgcataacaaagaggaagggagagggtgaaatagatggtgatgaggaaata

SEQ ID NO: 337384 - DNA, 416 bp, Homo sapiens
cgttcttcaagaaggaaccactgaattttaactggatacatgttgacagaataaagactaccttttccttgcagctaggtgtggccatgtagttaagatttggccaatgtcatgtgaccagaagtgatatgtacaatttcccttacagaacagggtcatgcccttccaacatcccatcctgatggctggaatatggacatgagggtgaaccaccttggaccatgtgaaacagggtaacaccccaagggcagtagaacaggaagacaacaagcctgggtctcagataactttgtagctcaggatccacataaaagattggactgttatatgagaaatccttttaaagatctataaggtctctcttgcatacaaccaacttatgtgctaactaatgtataaagtgagagaaaacctca

SEQ ID NO: 337385 - DNA, 408 bp, Homo sapiens
cccaatctaatgttttcactggcctaacaatgctaattttaaaacaaaattctactctttggatataaatatttgaaaagataaaaagaaactccacataacaaaagcagggactaagagcctaagacagagctctgtaaaacaaaagaatccatatgatttcaatattctaaatagtcatgcaaaatcatcacttttagagagctgatatttaaccaatatgcactgataccaaggtactgtttgcttttaagaaaaacaaacaaaacaaaacaaaacgctttgggaagccaaggcaggaggatcgcttgagtccaggagttcaagaccaggctgggcaacaaagggagaccccatctctacaaaaataaaaagaaccctgctctaagcctatggcttggaaccatg

SEQ ID NO: 337386 - DNA, 205 bp, Homo sapiens
aactgaagacagaaaaaggaaactagaggagcttcttaattctgttggtcaaaaggtatcagaactcaaagaaaaatttcagagcaggacttcagaagctgccaaacttgaggctgaagtaagcaaggcacaagaaacaatcaaagctgcagaagtcttaattaatcagcttgacagagaacataagagatggaatgcacaggtt

SEQ ID NO: 337387 - DNA, 407 bp, Homo sapiens
caaacaaacaaacaaaaaaacaaaaaaaccaactcagcagagaaagaaataaaaatctagaaagaaatcatctaaataggaatagtgaatacctttgatagttttgattgccatctttttgcttagccatatattctagtgttcctataatgaatatgcatgattatctaagaatatcatatgcaaaaaggaaagaaaatactagcttggagtccagcttctcccaagtctccttgctccttcttctcctcctggaccacagtcttccctctcactctgtgtgttgcatctgcctcataatgatggggaggacaattctagctcgtattcacaaaggtgtacctgtggagagcactcctctaagtcatgacacacgtaaattcatgtcctactcacgatacctctat

SEQ ID NO: 337388 - DNA, 1150 bp, Homo sapiens
tgcagcaaccctcccagccccaaccgcaggagctcacagtctcagcaggaatccagacttcagacatatacataggtcattacatatgcttgttaattgctatgataatgtatgaacagaatgctatgagaattaggaggaaattattaactgccaacggtgtcaagaaaggcttccagaaaaatatatggctcagtgagaacaggatttctgtctctttagcttcttctagcacagtattttacaaatattaggtgctcaaaataaatatgttgaatgagtgaattaatgaatgagatgattcattgcagctggtattgaagaatcgggaggagattttgtgacaagtaagagggagaagcatgcacacagcctggaggagtaaatggctacaaataatttgttttggcaaaagacattaaatgtgacaggagcaaaggtgcctgggagaggggtgatgggactgatgtgaggagcagggacaaagaggaggctgagagtgaaagatcttctgctctgtgcgaaagaatttagattagttctctgggcagcctcctcaggcaggggagtgacattatcagatttctctgatgggaagacacctctgggggccagtgtggaaggcataaagtggattagtgtgaaggaagtctggcaggaggaaggccagctaggaagattgaaggagtaagagcaagagatttggaaggtctgagctaccgcacaggccaacaggaatagaaaaggaggacccattagagacacttgtttgaggcaggagaggcaggattcaagtgagcagcgagtgtccagattagactttattttctaacacaaatggcaatggcattaactgaaataaggactccaagaaagggaagtatgaggtggagagagttaaagagctcagttttaaacaggttaggttgcagtcacctgtcagtccttccagggaagagaaattcccagcaggcatttattaagatgaatgaacagcaagttttcaaatggggacatggtgtttggtatcatcagcatcagggagggaggtgaagccatgggagcagagaacatccctcaggaaaagtgcataaagggagaagagagaggactaagaatgtattcatgaaaagtagcctttagcgggtga

SEQ ID NO: 337389 - DNA, 154 bp, Homo sapiens
gacaaatagccagaatgtgtagagccggaatttatctcagccctagagggctgatatacaaataaccagaatgtatacagccagaatgtatatcagccctagaggcaaacttacgaacgtatgcagtagcagatgtgtggttttcttttgttta

SEQ ID NO: 337390 - DNA, 224 bp, Homo sapiens
gctgtttatagataaagtacagtttgtacctagtttctatttgttctcttagtttctgtttttgagcttggtcatgaagccttgtttgggctatgtggccagagaggtttaaaagacatcttacataggactttggtttctctgagatcaaggcaacttgcatatatattggtggctcaaaatccaaagacagagtaagtcctatgtgactaagaaaggaacct

SEQ ID NO: 337391 - DNA, 816 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggagtggtgtttggtattctggagaaaccccttccgaaactggaaacggagtcgctcctttggcctgaggacgcggttcattgtcctggatcctgaccgaggctggtgcacctgcagcgacgcgctctttt

SEQ ID NO: 337392 - DNA, 1255 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggagggaggtgaggctgtggctccgggcctgcccccccgccgctccgaggggccaggatccctgggctgggggcgcgagcaggggcccggcgggcgtccgcgggggttcccggaatctgtgcctgggctgttgggggaggcctagatgaattccagtttagtctttgcctaattaaatattgtagggccacgcggttctatgcagtgatgagtcttccaataacatttaagaggcccctctgctcccttccaagaaggatgactaactctagattgatacagaggtccagctgttttttaaatggccattgaaaacaggcacatcgagtactcggggctatagaagttagcatacatcaaattaacccagtaattgagtcaaccgtgaacttctgaacgcgctccccaccccgaggtgctggttttaggagaaaggcaccgactggtgtttggtattctggagaaaccccttccgaaactggaaacggagtcgctcctttggcctgaggacgcggttcattgtcctggatcctgaccgaggctggtgcacctgcagcgacgcgctctttt

SEQ ID NO: 337393 - DNA, 2007 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 337394 - DNA, 788 bp, Homo sapiens
tgtaaatatttaatttttattctccatgtattgttttctcaggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 337395 - DNA, 1783 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaaaactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 337396 - DNA, 164 bp, Homo sapiens
caccttactatgaagaataataaagcaataataattaaaaaatcatatctgcctttaatataatagaaattgtaatttttgataatacctgtattgtgtttatatttctctctctttctccttttttaggtataaacaacataaaactgacttggaagcgattc

SEQ ID NO: 337397 - DNA, 1899 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 337398 - DNA, 1725 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 337399 - DNA, 2198 bp, Homo sapiens
ttttttttcacctaaattgtttttacttgcttcaccttaaatcagttattcggttcctttgaagaacatgtagctttagcaacccccaaagtgaacccagatacccagaactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccaggagggaacgggacgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaaccaaaaaaaaacaaaacaaaaaaaacaacaaaacaaaacaaaaaacaatcaaccaaaacaaccagcactagatccatcatacaaaacaaatatactcccggaggagggcgaccagtattaagaagactgttatctctacacctagtggttgcaacgaaaagtggtacccacatactagtagggttgactatataaatcgcccgcgcttttgagacccgttattattacaagcagggatgagagtgactaataattatacattggaggtaattacagttaaaagcgtgcatctattctgattt

SEQ ID NO: 337400 - DNA, 377 bp, Homo sapiens
tcccaacacgggattgaatttcaatatggggtttagatatttggagtcaaatatccaatacatagcactcccaaaagatgctgaaatcctaatccccagtactgtgactgggacattatttggaggtagggttgtatggaaaaatcaaactgcctttcctcttctctcacaccacaagtgtcaacactcctgtgactcctgtgatgaacgggctgaggatttctccccgccagcaagtcggcactcagttctgcagcggcgccagctgggtgtcccccagtccagttcaattccagcatggtccatctgcagacagcacaagatcccacagggtgagggctcagtcccacaagacagtcaccacttttttttttttt

SEQ ID NO: 337401 - DNA, 210 bp, Homo sapiens
tcccagctacttgggaggcaggctgaggtgagaggatcacatgagcccaggaggtcaagaaatacctctctcctggctgatgatgggactcagaagtgaaaagtaggagaaggctaagcagaagccaccacctaaggggaattactttagaaatgaaggtgccgtggggctcttgattcttttggcagtagttttatggaagcatggatg

SEQ ID NO: 337402 - DNA, 233 bp, Homo sapiens
aggagctgggtgtctggttggatttcaggatgcccatgtttaaatgcacaggtctgtgcccagtgcttctgggccagggccagtgcatctgaaaggtctgtgcttggctgaccaccccatagtcaggaggcaccgtctgagtgagttatgtgaggaagccttcagggtggcttatggccttgaccacagagcctgctattgagggcacagtgggcatcagtgttgggactgac

SEQ ID NO: 337403 - DNA, 621 bp, Homo sapiens
gggtgggtagctccctaaagaaaatggggttggagagtgccaagctggctcaaaccctggctccttcctgtgcatcttgtcacctggcagctggcagggaggcaaatgcagaggtcagggctgggcttgtggggtacaggcgtggcaccggaagacctctaggatcctggtggcacacatggtgtggatacgctgctgctctgtcccagagtcccccagcattcctttgacatcatttattgcctggcataggtgcattcattcacgtttgtcaagcagcacctgtgtgctgtgttggcaagaagtctgcttagggaaacctggaagtctggttggagacccctctgacctcccctgctcccttgtagcccctgggtctcgcgcacgccactcactccagtgtttgccttggctgtacacggtgaatcagaccctggtgtgccgaggcttcggggagcatggtggggggaatgtcaccatcagtgggctgcctggctgtggactgatgccccaaggtcaagaccagagtctgtcctgcgtctgcaggagtgggatggtgtctgtttggtcatcttggtgctgtccctttctctccacctcagtcactacccacctggtctc

SEQ ID NO: 337404 - DNA, 2882 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337405 - DNA, 3225 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacgcctattttacaccaaccccagctgttgtaactggagaaccgagctcg

SEQ ID NO: 337406 - DNA, 3133 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccaccgcggcccgccgcgatggagcgaagagtgggaccacggaagatggccagcggagacccgccatacagacaaccgagaaaaagacaagagacacgacaaagaaagcaaacagacgaatgagagggaggagggcgaagagagagaagaagacgagcgccagagagagacaagcgaaagcagagaaaagggcgagaggaagaggagcgaggcggaggggggggacgggcaggcgagagcgaggggggagcgagagggcaagagcaggacggcgagagagcacaggcggacgaggagcacggaagacgagagaggagagagggggagcagagcgcacgagcgagcggacggagagagcagagagacagccacaccacgcggaaggccgcgcagagaagcgacgcgaagagcagacgaaggccacagcaggccggacgcgagcgaaaagaggaagagcggagagacaccgcagcgacgcaagcgtcagaggaacacgacccagcacgcagacgacagaacgcgacggagcagcacggcgaaagcaaaggagaggggagggcggagacaggacgagagaagacggaaggaaagaagaaggagagagggagcgacgacgagcgggagcgggacgggaagagggacggaagacaagagggcggagaacagcgac

SEQ ID NO: 337407 - DNA, 2793 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagaaagtgaacgggatcctctaga

SEQ ID NO: 337408 - DNA, 2012 bp, Homo sapiens
  misc_feature (1803)..(1803): n is a, c, g, or t
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggcggcngtcgggctagtcggggccccgactagcccgacaggatacagtctcaccactgaagtcaatttaaatggaactattgataaagtgagtcagcagcttgaaggagccggcatacagtatatcctatctagcccacccaaggacactggctctgcaggtgggagaagtgaggggaggggaggagtgcccagccctgtcgggctagtcggggg

SEQ ID NO: 337409 - DNA, 3094 bp, Homo sapiens
ctcgccgcctcctcccgccgcctgcggcccccccctcgccggcggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337410 - DNA, 2521 bp, Homo sapiens
atgcaggttactctagaggaccccgaacggggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337411 - DNA, 2538 bp, Homo sapiens
tcgcgtcatagctgactcttgaggataaaccgaccgcggaggagtctggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337412 - DNA, 2693 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337413 - DNA, 1304 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgcttttgtgatccgggtacgagctgc

SEQ ID NO: 337414 - DNA, 1980 bp, Homo sapiens
gcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337415 - DNA, 1889 bp, Homo sapiens
ctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacaggtaggacagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337416 - DNA, 1831 bp, Homo sapiens
gtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337417 - DNA, 560 bp, Homo sapiens
cggcacgaggcatatgcttgtctcaaagattaagccatgcatgtctaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337418 - DNA, 2882 bp, Homo sapiens
cgccggagcactactcggcgctattttctggaacaatgactattttgttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337419 - DNA, 2539 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337420 - DNA, 1948 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggagcaagcggcacatatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctacacacggactcgccttta

SEQ ID NO: 337421 - DNA, 2968 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337422 - DNA, 3036 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgcctttcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagaggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337423 - DNA, 1675 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggatcgtgagagagtgaaggatcgtgagagagggaggat

SEQ ID NO: 337424 - DNA, 1711 bp, Homo sapiens
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacaggctccgcaaaaccagccggaggaggaagcagggatggaggctgcttctcctgagttcagaggagatccatgtgctatgggtggagggaatcctgggtcaggggccag

SEQ ID NO: 337425 - DNA, 1169 bp, Homo sapiens
  misc_feature (1100)..(1100): n is a, c, g, or t
  misc_feature (1157)..(1157): n is a, c, g, or t
ggggttggggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggagtcgagacattcctgcgcatggtgcagtgccgctctgtggagggcagntgtggcttctaggtgcccgagtagcatcctgtgacccctccccagtgcctctcctgnccctgaaggtgc

SEQ ID NO: 337426 - DNA, 769 bp, Homo sapiens
gaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatcta

SEQ ID NO: 337427 - DNA, 2152 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacgctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgagttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337428 - DNA, 415 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtaagtgcatctacttgttccagaacagatgataaaacctgactagctaaattgctaaagtggaaagttagcagccttcagtgttcgaagtaaaaagttacccctcactactttaaactagtccaaacttatgttaatgaagtgaccaatgaaacgttgatatgtggggagtagtgtaagggagagtatataattgaaaggtaact

SEQ ID NO: 337429 - DNA, 2642 bp, Homo sapiens
ctctggtccgggaagtccatactctggaaggtgttccagggctagcgtgattccgggagtgtgctttctctttcaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337430 - DNA, 2554 bp, Homo sapiens
gaaaaacaagcaatagagcataagctttgtgtaactatgggggcttgcctaacccttgataagccattttctctgtaatagagtgaggtattatcttcaactatgcagcagctgtcccaaaactaaagaatattttccaagatgctacaaaaatcagtaactctgtataagagtatcatgtaggatctacattctttatgaaataactggcagttgaaaccacgacggaattcttttagaaatagactttcctctttcacttggatcttttttttaaattttctccttaattaatctcttgcagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337431 - DNA, 2378 bp, Homo sapiens
atgagatggagtttcactcttgtcacccaggctagagcacaatggcatgatctcgtcttactgcaacctccacctcctgggttcaagcgattctcctgcctcagtctcccgagtagctgggattacagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337432 - DNA, 1847 bp, Homo sapiens
cagtggcatgatcttggctcactgcaacctccactttccaggttcaagcagttctcctgcctcaacctcccgagtagctgggactacaggcatgtgccaccacacctggctcatttttgtatttttagtagagacagggtttcaccatgttggccaggatggtcttgatctcttgacctcgtgatccgcccaccttggcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337433 - DNA, 2213 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagagctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337434 - DNA, 2649 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337435 - DNA, 1664 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctgaaagtgggtaccgagctgaattgtatcag

SEQ ID NO: 337436 - DNA, 269 bp, Homo sapiens
gtatacgcttggagttgttttggccttttgaaatgtgtctctgacccacattctaaatttttctgctgtaggcgtgaaaccttcaaccacctgacctcatggttagaggatgcccggcagcactctagttccaacatggttatcatgctcattgggaataagaggtaaaattgtatccatgtgaataatagttaacaggagtcatctaggtactctatgcacattgatccccaaactttctcagtttatagtggtcttagtgtttcagt

SEQ ID NO: 337437 - DNA, 2703 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337438 - DNA, 2620 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337439 - DNA, 1916 bp, Homo sapiens
ctctggtccgggaagtccatactctggaaggtgttccagggctagcgtgattccgggagtgtgctttctctttcaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcaccacaggaagttggaagacatttggggtattgctttggttatgcttttgttttgtttttaaaatcctatctgattccaaaaaggatttgaagctgttgaacttggagttagcctgcccccttacctctgggcgaaaactaaagtaataaaaactagtttctgtac

SEQ ID NO: 337440 - DNA, 2379 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactatacacaacctcttgacgaatatgtacacttcttcaatacatgcatgtcac

SEQ ID NO: 337441 - DNA, 1164 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctagcactttgggaggccaaggtgggcagatcacctgaggtcaagagttcgagaccagcctgaccaacttggagaaatgccatctcaactgaaaatacaaaattagctg

SEQ ID NO: 337442 - DNA, 524 bp, Homo sapiens
gtggctcatcccctaatcccagcaccttgggaggctgaggcagatggatcacctgacatcaggagtttgagaccagcttggccaacaaagaaagacccccatctctacaaaaaatttaaaaattagccaggcatggtggtatacatgcctgtaataaccagctacttgggaggctgaggtgggaggattacgtgagccagggaggttgaggctgcagtgagctgtgattgcaccacttcattccagtctaggcaacggagtttgaccctgtctcaatataaatttttaagcaaaagtaaaaagtgccagttactgagtcaagaccatgaggcagaaacaaacttctgcctatcggtgaattcttgccttaatctgtagttagaaggtgttagtgatgattcccagttttgaattatttcttgggatggacatgttgcatatactagatcaaataaaacagtatatgtgtatatgtactacagctatatctatctacatagatatatacacacatatatactttt

SEQ ID NO: 337443 - DNA, 447 bp, Homo sapiens
tgatgttagatgtcatcgtatctattgttgtaattggtcctgatagcttccactggcttaaccaaagctcttttgtcttccaagctaacctgtgtgaaagcgacagtggtgcaggtcttcctgtggactagacattctagtcttgccttccccttgataatgcagtgagggatcctcattttatgacgcagggcaggcaggaagacgattagttcaatgggatccatgtcatgtgcagttaccatcagttgagccttcttattctccaccaaggtggtgatagtgttaatcctgctcaaagaacaggtagtctcttagtggacacatcccctttgccacagctttcttctcagcctgggccaacagcctcttctcttgctttgtctctggtctgtacttgtgggccagcttatgcagctgagtagctgtttggtggtccaaggcctg

SEQ ID NO: 337444 - DNA, 186 bp, Homo sapiens
ctttcagctaagctgtagacctctagcagatgaacgacatattttcctgaagggtgtgaagaggatactgacccaccagaaagagaccccactgctagaacgaataagatgtgctgaaagccggagcataacttggccattcccaagatttaacaacaaactaactacccatcattaacagtaaag

SEQ ID NO: 337445 - DNA, 885 bp, Homo sapiens
cctctctgtacagtacaaatgtatatacatgcaggtgtgtgtgacctcagagcacaggtgcacacacatttggttattactgactgggtcatagagcaactaaaatctttagccatcggtatttttcttcacaattaaaaaaacaaccaagataatgttaaagtctcttacaatcacaccttcaatcttctttttgtcaataatcgttctttcaacacatatacttcaagcactctgtatgtgtcaggcactcacacagcaagggcccactcatcaatcatcagttagctacaaacaccacaaattcagcctcaaatgctcatgcagcaggggtgaaggtggctcataaaaagcaaaggtgtagggaaagaagcagtacaggacaggggaatggttgagagtcaactcttagcaaggttgcttgaattctaatccccatctcctcacttactagctcactgaccttgggccagattcagaacttccctgtgcctcgttttcttcatctgtgaaatggaaaaaataacagtgccaaccttgcagggttgttctatgggttcaatgagataatataatgtcaagtgcttaaaacatgtctagaacacaacaaatgctatgccaagtgttaactacttcttagcattcagtgacccagctcactgcttggcacatcacaggagttcaaagaacattcattgaatgaatgttaaataagaaaaaacaaactgatctcattcctatgtactaggcacactaggaaattataaaaagtaaatgagctcatctccaatgagtcagtccaatgaaaagatgagaacaatggtccctgaaattattctgcttaattacttccttgtgattcaacatggaagtataaagcgttga

SEQ ID NO: 337446 - DNA, 845 bp, Homo sapiens
gttgtaagaggtgaaattgccaggtggcaaacccctccaaggtgtttcctcacactttctctgttaaaaacaccataagataccctgacaaggagactttcctggtgctcatgatggagaaagagcactgaagagagaagaaaagctacatcagtgatgaccacatgtgctgtgcggtgtacgtggtgtgtattttcattgaatcctcaagacagtcacagacccagaggagcagagcctggggaaagtttcccttagtctaaggttctacaaccatcatgggaacatgggttctgaagctgggtcttgctgcccaggcttagctctgctcttccctctcactaataccctgcctgatgccaggcctgggcatggggtgctatgcaccatcagtccacaggtgagccctgcaggtgtggagggagcacgggaaggtgtgggactgagctgtggacaacacaagggagaaagccttggaagctattatctgggaggttggcaattatggggtgataactggacaactgcaatataaagtggaataagaacccaggagaataagaacccaggaataagaacccaggagaagaagacaactaaggagagggtgctcgatgaaaacacagaagcccaggcccctctctcacaggcccatgcctggttagctctgacaccagctgaataggaagcacggcaagtttgagactctcttgcataaaccataagcctcagtgtcagggacatgtgctgtgaggacacatgagatgtcagtctgtacagggcagatagggaacaaggcatgttcatcaaacaagagctgcacctcccagccttctgcatggggt

SEQ ID NO: 337447 - DNA, 641 bp, Homo sapiens
gttctgtaggagatgaaaggttgtaagaggtgaaattgccaggtggcaaacccctccaaggtgtttcctcacactttctctgttaaaaacaccataagataccctgacaaggagactttcctggtgctcatgatggagaaagagcactgaagagagaagaaaagctacatcagtgatgaccacatgtgctgtgcggtgtacgtggtgtgtattttcattgaatcctcaagacagtcacagacccagaggagcagagcctggggaaagtttcccttagtctaaggttctacaaccatcatgggaacatgggttctgaagctgggtcttgctgcccaggcttagctctgctcttccctctcactaataccctgcctgatgccaggcctgggcatggggtgctatgcaccatcagtccacaggtgagccctgcaggtgtggagggagcacgggaaggtgtgggactgagctgtggacaacacaagggagaaagccttggaagctattatctgggaggttggcaattatggggtgataactggacaactgcaatataaagtggaataagaacccaggagaataagaacccaggaataagaacccaggagaagaagacaactaaggagagggtgctcgatgaaaac

SEQ ID NO: 337448 - DNA, 217 bp, Homo sapiens
tgcgtttccttgtttctttacctcattttattcttctagatcttttcttccctttcttcaatttttcattagatttttgtttcaatttgttcttgtttggtcctcttataatttcatttctgataagattttatctgtttcttctatttcttccctgagttaaatcagctcttcttttctgcatgcttttgtctagtgcgtgcgtgtgtgtttgtgt

SEQ ID NO: 337449 - DNA, 647 bp, Homo sapiens
ctgtcatgatcacttctagatccccagtgtctagaacagcacttgacatgcagtaggtatttaatagatataatgtcattcccctgtgaaaaacacctcaacagttccccatcgcctcttaggtaaattccaacctatttaacatgaattataaaacccattgtgatatggttcctgcctcaactggaaccactgttttcacactctcaatgctaagcctggaacattcttccatatcctttcctcctcatacttagctaacccttacttatgctttcaactctcgtcttaaatagtacttcagaaaggcttttttttaaatcattcaactaggtttactatgattaatctccttgccatattttcttatagtagtttgtcttttctctatcataaagtattaattttgtaattactcagtatgttggccctgacaaaatacatattccttgaaggcagtgactatgtctgatttgtataccattatatctctactatctaacacagtatttgacacatatggcatactcaaatacttatggaattcccaagtgaatcatgaaaattcacactcacacaaaaaggtgaattagacacttagatcacctttaaaatactaaagcatagtaattaagtactttgaatat

SEQ ID NO: 337450 - DNA, 343 bp, Homo sapiens
caccaacatctgcctctggggagacctcaggatgcttttacttatggaggaagatgaagcaggtgcaggcacttacacatggcaaaagcaggagcaagagagagaacgtgtgtcgggggaggtgccacacacttttaaatgagcagatctcacgtgaactcaagacgagagttcacttattaccaaggggatggcctaagccattcatggggggatctgcccccatgatccaaacacctcccaccaggccccatgtgaaacgttgggggttaccattcaacatgagatttaggtggggacaaatatgcaaactatatcaattagtaaatatgagatcatagca

SEQ ID NO: 337451 - DNA, 156 bp, Homo sapiens
atatcttttgagattctcagcttcctgtggagacaccatgtctcaaaagcatggagcagtgtacgcaaggaccttgtggaaatatgctctttagaaggagccacagatagatgctaccagcacatttctggaaagtgggtacagcacagattgcag

SEQ ID NO: 337452 - DNA, 214 bp, Homo sapiens
ttatacagatacgttatttgaacccaagtctttcaggctctagcctatgctagccacgagaaaactcaagtactgtgatagctgaggaacaggaaaacattgcataaaggaagtaagtgacttacagttttcttatgacacagaaggaacatgagaatatttagataagaaaaagccatagcatttatagcttgttcaggtctttgggaaaaag

SEQ ID NO: 337453 - DNA, 866 bp, Homo sapiens
aaaagaaaagaaaaaggaaatacacataagaatgtgtgaaactaaagaactatgattagtctaaattaacacaaaatgctaagggaacacaaaaattatgtctggagaagttgtaaatataagaggtggcagaaatacattccaaaaagagaagaaataagaaggcatggagtttggaaacggcaagatatgtgcatgaggtgatagagacaccacaatggataaagtaggacagaagcatggttttgattaggtagacttatggagccaggcagaaaaagaaaaatcttcaagcaaacaagtacaggttagatttgaatagacaaaaaaactgagtcactgccaggtaattctttgttgtggaggatgtcctgtacactgtaggatgtttagcagtatccttggcctctactgaatagatgccattagcaccacttcccaccaagtagtgacaagcaaaaatatctccagacattgtcacatgctcccttggaagacaaatccatcctcctcacccccatggagaaccacttacctagtccaactccctttatgagataaataaactgatttcctggtaagtcacataacttgctacagtcgcacagcctagtttgggttttgttacagctagaatataaactaagcccaaaagcactggtcacagtaggctctgtgatattcctacattataattagaatggctaacaacaattctttagaagttagatcaaaattatttttatatgcctaagatgaacactttactgcaatgtatcagctattgtttctgtgcctttaaagaatcaatctttaattaacaaaaacaacaacagaaattgagctactgagggagctcaaacagg

SEQ ID NO: 337454 - DNA, 356 bp, Homo sapiens
cgtgagccaccgtgcctggccccaccagactatcttaatcacagttacattctagcatattctgagaggtggtggagcacattttctcccattgttcttttacatagttttcttagattattctaatgggtactctcttctgtgtgagctcaataaatacattataaaggtctgttgaattagaaaagaaaaccccataggaatctggtgagaataacattgtgtttaaggattactccatgtagtaggttgaacagtgtcccccacccccagaagatatgaatgcccagaacatgtaacatgacttatttggaaaaaaagtctttgtagatataactaaattaaggatttttgag

SEQ ID NO: 337455 - DNA, 303 bp, Homo sapiens
tctgggtttttccaggcaagggtgacaaggaaaagggaataagagagttgaggattggcaagaaaaagactgaaatgatggaccatgcaatccaggctccaaaggcagacatgtcagttacgttgctaggacagaaactatgacttttcccttctttttcactaaatagaacccctgtataattatagaaccgctgtataataatcagtgtgtacctagttaaaagactacgtttttagttttccagacagctaggtacagccatgtctctgagctctggccggtgaaacaaaaggaaatgtg

SEQ ID NO: 337456 - DNA, 423 bp, Homo sapiens
ccactgcgcccagccggcatccttaagatttttaaaagttgtttgggaaaaacacgcctattctcattattgagactagagagaatgtttacccatggcttctcactgagggcagttagagatactgaaatcgaccttaatatccttaaagtaaatactatgagtttttcccaaggctgttttttcaaacattccttactgttagccaattgcacaatcccaaagcttcggtaaactacagaaacttacaaaagaggcccccagtaggacacagcataggtatccatctatttgctatagatgtgtaagaatggagaaaaactctccatcaatactgtgctttcagctgagctctgggacagggctggaacagttctgagtctgaggtaacagcagataacctttggccacttttatgcgtag

SEQ ID NO: 337457 - DNA, 837 bp, Homo sapiens
gctttattgattttaataaaaacaatactgtatcaaatactgaatacattttatgcatattataaaataaactccttgtcatctttctttcacaatatattccacaatgatccataaggattagccactatttttccaggaacatattaaaaccgtttatcagtgatattacatcttgcattgggaaaaagatcccagtgtaagtctgagacccatttgtcaagaaaaaaataagtgaaaaattggtaagtaaaataaattatagacaaacacatatatacactgatatattaatacacaatgaacaggataattcaagaagcatgtaagatacgtgtcttaatactttgttgaagccatgatttttatatacatacacagagtgttgaaatgattctggaggaaatgtgcatctatacaatattggcagaaatttactcatggagtcagaaaagaaatgatgagcaccagggaattcagatagtaaaaaatatcagattatctcacactaatactctcatattctagcaaagtggtgaattaacattggtgttctagcaagagtaaatatatatggatgactctgctagccatcagtttcctgaaaaataccataaatataaattagggctgcaaactatgttagaaaggaaaaatggaaatggattaataaaatgactgtcaggaattaaaactcctattctttgtgtctctgaggctagttctatgtagtgtaaaaataatccacttagactgatttctctatcttattccaaactgattgaagatatagttcatcttccacatgtcttcaagtagtaaactcactacgatgtg

SEQ ID NO: 337458 - DNA, 129 bp, Homo sapiens
ataatggactgttttctctcatggatgtaaatgcaaaaaactaattatattaacaaaccaaaactacacttgatcttagccaaaaggccaaaaagtaatgacaaacccaaactaaatccagtaattggt

SEQ ID NO: 337459 - DNA, 272 bp, Homo sapiens
attggagtctgcgtcgacaataaattggatattcagttattgaaaagagatagatgtataagtatttacagggaaaatggctaagatgtgttacaaattttaaaaaagcaagttgtgaagaatgagtgctaatttttatttgtttttaaagcgagatggtatcagatagtgttctttagtaagcataaaaaagtttctgataaaatatataagacagttttaatagttaacattgtttacctgtggattttgtaactaggaaaccaggaggc

SEQ ID NO: 337460 - DNA, 715 bp, Homo sapiens
attatgtaatgattttctttattaaaaaattctttgcctcctcgactcaccaggaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337461 - DNA, 756 bp, Homo sapiens
attatgtaatgattttctttattaaaaaattctttgcctcctcgactcaccaggaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaaaccaacaacaaatggcctcccccggcccacccggcggacct

SEQ ID NO: 337462 - DNA, 826 bp, Homo sapiens
  misc_feature (56)..(56): n is a, c, g, or t
taaaaatacgcacacatccccctggccacgcaagacgattctcaccctctatactngcagtaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatacccaatgctaactgttccttatcgtcacaacaataggctccttttacctctatccttcgtaactcttccacctctcatactacctctcatcctgatctcgtcatttcacatgtcactgcgcgaaacctctctccctcttcaaaaatcaataaatcatattcgacctcactagaactttctctctccactcaattcacaaccaatactcgtccatcatagtctttatatgtcgcgtacccttgcgactttcttctttccaccaatgt

SEQ ID NO: 337463 - DNA, 831 bp, Homo sapiens
tttctattttcttaatgctgaaacaattgatcttgatggaacaatcttgtttttatataaaatttcaagctggtgatgacatgtgtaaaaggaaaagtgctgcaagcagtaaatgctgttcagtttgcagtccattacatcaacatatctaaatgatcctctttagcccaaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337464 - DNA, 739 bp, Homo sapiens
acaccccctctccctacatccccacacatcccacccacgcgcgcgcccactttgataattacagcacgactttcttccaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337465 - DNA, 717 bp, Homo sapiens
gttctctgtgcgtaaatctccccttacttctatttcccccaaccactgagggtttaaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337466 - DNA, 722 bp, Homo sapiens
  misc_feature (56)..(56): n is a, c, g, or t
taaaaatacgcacacatccccctggccacgcaagacgattctcaccctctatactngcagtaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337467 - DNA, 728 bp, Homo sapiens
  misc_feature (46)..(46): n is a, c, g, or t
  misc_feature (52)..(52): n is a, c, g, or t
  misc_feature (67)..(67): n is a, c, g, or t
acctccaatatttactcacgcaacactgataattaccccccagcgngagagnccttgtacgatccgnaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337468 - DNA, 720 bp, Homo sapiens
gcctccctctactacagccacacaattatcatttttcaccaaaaaaaaaaaagcttgacaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337469 - DNA, 713 bp, Homo sapiens
attatccgcccgccatttacagaaaaccaaccggggctccatgactaccaggaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337470 - DNA, 715 bp, Homo sapiens
  misc_feature (41)..(41): n is a, c, g, or t
  misc_feature (43)..(43): n is a, c, g, or t
  misc_feature (54)..(54): n is a, c, g, or t
tggatacgccccacagatcaaaaaaggagggcgggccctcngngactacccacnaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337471 - DNA, 716 bp, Homo sapiens
attacgtatcttatccaccaaagagagagggagccctcctccaggactacacagcaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337472 - DNA, 735 bp, Homo sapiens
tttctattttcttaatgctgaaacaattgatcttgatggaacaatcttgtttttatataaaatttcaagctggtgatgacatgtgtaaaaggaaaagtgctgcaagcagtaaatgctgttcagtttgcagtccattacatcaacatatctaaatgatcctctttagcccagtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337473 - DNA, 926 bp, Homo sapiens
  misc_feature (742)..(742): n is a, c, g, or t
  misc_feature (745)..(745): n is a, c, g, or t
  misc_feature (747)..(747): n is a, c, g, or t
  misc_feature (752)..(752): n is a, c, g, or t
  misc_feature (868)..(868): n is a, c, g, or t
attatgtaatgattttctttattaaaaaattctttgcctcctcgactcaccaggaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaaaaaaaacgggcctcgtttgcctaccgnggnantctgnggcgcttccctagtggggggaagttagatcctcctcactgacccctgccctggtccttccatgccccgagcggattccccctccacggcggctacgtcccccagactaacgtctcncgccgcatatctgcgcccacgcccccacccctaacctcaaaggccaccgcgcatttcc

SEQ ID NO: 337474 - DNA, 834 bp, Homo sapiens
  misc_feature (748)..(748): n is a, c, g, or t
  misc_feature (752)..(752): n is a, c, g, or t
  misc_feature (762)..(762): n is a, c, g, or t
  misc_feature (777)..(777): n is a, c, g, or t
  misc_feature (791)..(791): n is a, c, g, or t
  misc_feature (834)..(834): n is a, c, g, or t
attatgtaatgattttctttattaaaaaattctttgcctcctcgactcaccaggaactatcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaaaaaaaaaaaaaaagggcctccgtggcctcagcngggngagttctggnggccccttccctttngggaggggtaattnatgacccctggttactgacctcgttgcgctccgagcgtccgan

SEQ ID NO: 337475 - DNA, 639 bp, Homo sapiens
  misc_feature (71)..(71): n is a, c, g, or t
tcacccaacccccccgcgctcaccacaacagaatcccgccacccatatcaacccttgaggtccttaccctnagggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattatccttataaggagatgccatttttctcaatctttccttaaaatctaactaacttctttactaagtcatttctgttccttatagaatagtgaatgtgactgttcttagtgtattgactggtccctttacatcagcattgtaacttttaggtattagtttactttcatatgattgttatttcatatatcattgtgaacatatttttttccaaaaataaaatacatattgacctaaaagaaattgcatctaa

SEQ ID NO: 337476 - DNA, 510 bp, Homo sapiens
actccacaacaccaccttaaaacaaattttgagtgattccacctggaaaccttactacctcaaaagtattacattttgggaacactaatgctaggctcaggctgcccttcttctagacagtgtgtgtgaaatgatcagcatagctcaacacaggttttccagtacagtcaatgggtaaataaaaggagtcccagttgcagcagcaaaatcattcagatgggaaggcatccagtgatctaaaaggactggaagattcttttaaggactggaaattattattataagctgctcaagtaaagcagcttctaacaacctacacggaaggtaggcagtgtttctaagtggatgaattcattgccataagcatttcacctcaacgtgtgacctaaggagggatcaccttggtgtctagacccttgtttgttctcagatatttccattcatgcattcattgatagagatttgtagtaagaaagccattaactctctcccaaccacttaaaaatagca

SEQ ID NO: 337477 - DNA, 219 bp, Homo sapiens
tgctgcgggttgggtcatttgaggaaacatccagagaatcacagattctcaagcatttggtcaacacatatttactgagtatctgcattatgtcaggcactcttctaagcactgagggtatggcagtgtagccaactgacaaagttccatgccctcatgaagctttcattctagtccaagcacagacactaagcagcatagtaaaaacatgtgtcaggt

SEQ ID NO: 337478 - DNA, 588 bp, Homo sapiens
ggggagcagtttgtatccacagctatgaccccatctgtgaattactgagcacctattctgggccatgcaccagaacacaaagatgaataagacttggtccctgtgttcacagagctcacagccaggtggagagagagccttgtcaatacagtgtatgttatgctatgatgcagagaacacagggcttcttgcaggggaggctgtggtgaaggggagagctactgggagagccctgggggcgggcatgcctgatctgagtcttaaaggggatggacagacgttcaccagttagaagagtagcccaaaaagaagcaaaataggcaacggcacagaggcatgtgaacctagtgctgccatcttggatgcatgcgggagaagagaaaggggaggctgaggaacaagcagaaccaggcctagaagggcaggctttgagcgtaacatcccaggcttagcctcatgcctggagctgcgaggaaggtcaaagagcaagtgagagccaggactcagatttaactcttaagtggcttcaagtctatatgctcagaacggtgcccggcaggtagtgagcactcagcgctgggtattccg

SEQ ID NO: 337479 - DNA, 490 bp, Homo sapiens
cccattacttatatataaaaaatggcaattacaaaagtctatttcactcactcttgaaatacagatacaatccttcattgcttaataaaataataaaagaagttttaagaaagtgaagctatctgagaaactttcatgagaaaattaataattaaattctgaaattgaaatataaatcctaaatcgtaggaatattaagattataaatcttcacactagaatctctacattgaactacagccaaggtcacaatcatgagtttttcccccttctttttaaaataaaacaagaactatgtcattttctataaaaatttaaaccatatttcttcttgccatttgaaactgaaattcatttccttatgaatatttcaataccattctcctacaagcaagaacaatctatcagagaacaattttctaattgttttacaagcttacaaagcacataatgtcacaaagtaaaggtcctgggtgaaagaagagaaggt

SEQ ID NO: 337480 - DNA, 692 bp, Homo sapiens
cccctctttcatgtatttattttattttatgtactggtccttgttctgtctataaatatgcttaagctaaatgaacatttcctgaccctgctactcttccaacactattgaccacgcttctctaatatttgctcccttgggttctgtgacaccacttctctgtgtactcctatttcttccctggtttgtctttttcccttcccatataacctaggcagcattccttggtactctgtccctcgctagtctctctctctccctccctctctctctctctcctgacaacctcatactctctcaaaacttcagttacattcaacatgataattagcatcttttatgcttatatgctgctttaaaatttacaaagcattttttcatatattgtctcacttaattgtcataacaaccctgcaagtgagtagagcaggcattcactaatatgacccttgtcttacagatgaggaatcaagatcagagagttcagaagttcaaggtctcataactagaaagtgtcagaaccagaataagggccgggcatggtggctcatcctagcactttaggaggccgaggcgggcagactgcctgatctcaggagttggagacctagcccgggcaacataggaagaccttgtctctacagaatattaaaaaattagccgagactgtgtgactgcatgcttgtaattcc

SEQ ID NO: 337481 - DNA, 4766 bp, Homo sapiens
  misc_feature (2888)..(2888): n is a, c, g, or t
gcctggttaaccggagaaagctcctggtaaagaagaatccataacagaggcaaaacatactggccagttttcgcccactgctgaggtcctgagggcagccacagcctctgagccaaggggagttcagtgtccataagccttggaggcttgcttgcacaagaaccgctttgcactgcaattttggggtaggcaggagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcnacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagccggccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttat

SEQ ID NO: 337482 - DNA, 4927 bp, Homo sapiens
  misc_feature (3049)..(3049): n is a, c, g, or t
gcgcggcccgggcgcggggcggcggcagcggcggcgcgcggggaggcggggaggcggggggcccggccggacgcccctgcgccccctccccgcgccccggccgagggcggagcgcgctggccctgcagcctccggcccgcccccggcccgccgcctcccccgggacgtgggacgcgggcgcaggcggggtccgcgcggcgggcggcgggggacgggcggagtcaaaagtctattgaaaaagcagagagagaatgcctcggtgtgtaagtggagtgatgaggacctgatctctgggccgtgtgggaacactggctgccatttcatcacagtcaacctggactcacagaatttcaagagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcnacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagccggccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttat

SEQ ID NO: 337483 - DNA, 423 bp, Homo sapiens
acacacacacacacacacacacacacacacacacacatatatacagcctctgcctctaaccagatcctctgggtctctgctctgtgggccatatggaatccacaccggtcatttctctgtgtattctctcacctccaaggatatgggtggagggcctttaaatctccttatgaaggaaggatcccttcctattggagtcagggctgtacatgaaggcccccagttcctccatgctagacacatccccagaagcagcacctaatgggcaacactgcggaatcattttccacccagatcaggggcatcccacggacacttattccagaaaactgaagctgggccacaaagaaggctctcatccttgctgctatttgccctggaccacttcaaaatgtgacacatcgggctgcagtgagctgagat

SEQ ID NO: 337484 - DNA, 345 bp, Homo sapiens
gatagtgtgatgcaagacagaactcagcctctttcttctttcctcttgaaatcagcttctcctcctgtttcttttaaaaggtcccttgccctctggctcccctaggtttgcatacctagtgttgtttctggcctcttcctggaatcatggatgccaaatcctgttaattctgttctcagtgcacctcacttgttctcatctctcctctaacctctgcttcaccttgactcctgtatctcaggctttccgtacttcactcattcgtcacaacattgagtcctactctgtgccaggcaacttgaaataaaggcaagacagggaaaggaggctaaatctgaactcatc

SEQ ID NO: 337485 - DNA, 638 bp, Homo sapiens
gtggcttgtcctaggatacctagcacagagaactctgtcccccaatttcttagttgcccccacccattccttcctcacatcagcatgggcaaggccagctgtggtttgggtcactgttcaggctgtacttttaggatcctcccaaatagcaaacaactatgtgactatcaggtctttatttcatgggttataggagatagggtcagtaagcctaatgtgtaacagtttcagtggttattacagagttccattgaattgcaacaactccctttaaaagcacaaactcccaccaagaaaatctcagtttcttcattaatcctaagagctttcctatctaggtatcactcaaaattcctactattctgggggcaatgggatcagagggtgttgcagagaaaaatccagagaaagtgaaaagtctacttccttggcagtgctggtgaagcatacccttacacagacgcttccccatgggaacaagtgccaggaactgcttcaggcttacgggggaaaacagtggctaagaagagagaggaggccgggcacggtgactcatgcctgtaatcccagcactttgggagactgaggcaggcagatcacctgaggtcaggagttcaagaccagcctggccaacatgg

SEQ ID NO: 337486 - DNA, 247 bp, Homo sapiens
atttctggtgaggagagaaaaccttaatcccagagataaagcacagagtggggggtggttgaagtcagccctgctagcaaggaaggctgtgccgaggtacaaagtcgattcaaagaagtcacttgcatttgctcccagttaaccaaaacctctctaatgttagaagtcactggcctgagcctgtggggttcatcctctgtccctagctcccctactcctgccacctcagctgtccccgcctcccatc

SEQ ID NO: 337487 - DNA, 206 bp, Homo sapiens
aacattgcaaaaggtccctgggctccttcagaccagtatttcacatacattttaaacccatgatttcaagaactcattttcccccttttagaggttttgataccacgtagacctactcacagtgagtacagggagaggcaagttccaaggtacagcttttatcatttttcccttattttccaaacatgaaattatgttacataatt

SEQ ID NO: 337488 - DNA, 373 bp, Homo sapiens
ccatgttgtgcccacagcacaggggcaggtatgaaatgccattctcattagagcttggatttgtggtcactatgtcaatccctggttctggtccggaccctgctgctaataagcacatgaatcccttccccactctgggcttcattgttcccattctatgaaacaatcacataatatatggccccttccagctctgattatctgggccaggtaggaggtagactcagaggtaggcaccagccactgggatggggcaatggggagccatgggagattcttgagcacaggggtgtctgatgaaagggtgctgcagggatatgaacagtggggtggaatgaagagccaagaggtggggacagactttagagcatca

SEQ ID NO: 337489 - DNA, 637 bp, Homo sapiens
cgcccacctcaaaagaagaaaccaagaccacctcctgttctgagactggaagagacatcatcagcctctctagacttgccgaagagagaaaaagaacagcaggaagcaactgaacatattgatgaagtacaaaatgaaatagacaggcttaatgaactaagggaggagattctgaaagcagaacagaaaataaactctgtcagccactttttcagaagaggtgagaattgatcgccaaagttccaagttttggggttacaacgtttgtcaaccatcctcaagtgtctgcactgcttagggaggaggacaaagacgcactgcattatctgaccaaagttgaagtgacagaatttgaagatactaagtcaggttacagaatagacttttattttgatgaaaatccttcctttaaaaataaagttatcttcaacgaatttcatttgaatgagagtggtattccatcttcaaagtccactgaaatcaaatggaaagctggaaaggatgcgatgaaacattcaagtcaaacacagaataaagccagcaggaagaggcagcatgaggcaccagagagcttctttatctggtttactgaccattctgatgcaggtgcttccgggatcctctagaacaccgccaa

SEQ ID NO: 337490 - DNA, 273 bp, Homo sapiens
ccccactgatggcatgcaactcaaaatctggctgcaccatttcaaaagaataccttacttctccatttggcccaaagtctttatctacagcacttactttgcccacaaacgacccagccctctgctcttcttcgaagtaaaatgtgtaattggtactgttaaaaagaggtctgttatcatttacatcttctaaaattacagtaacattcacagtagcactaaggggttccactgctctgtcagaagcaacaaccattaaaacatatctgtctt

SEQ ID NO: 337491 - DNA, 537 bp, Homo sapiens
tgcatccacttcccagaggaagagccactacagacgttaagcagcttaaagacttacgtgacagacttttagacagcctatgagcttaaatactgcttccatagcaaactctctgtcttccttgtatattttcttttttaaaggtttgttgtgacttttattcccaatatccaaggaagctgtaataattatgttaagattcaaggtatactttcttatgatataatcaattgtctgtccttggagattcattgtttcattctatatgactgtagcatttaaagaagttaatatgaataaaagactaatctgcatacacatctatacatttatagcctgcatacagggcctagcacagagcaggacttcactaagtgttcatttggcttctctatcaaatgtagaacacaggagggctcaagagatactattattggcttaagttattctctgggtagaaagtactaggccaccttttcttcacttttccagtcagtgcttgatctttcagtggcaagaggaagtcttgagttaata

SEQ ID NO: 337492 - DNA, 145 bp, Homo sapiens
aaaatattgaaatataaaatttattcaaaagcaaaataacagcttctatgaagtatgagctacatataataagtaaacagcacagtaccaaaaattccattttttcaacacatcagtatcttctttgaattacacattttctccc

SEQ ID NO: 337493 - DNA, 208 bp, Homo sapiens
ttatacataatcacaaccttttgaaaaactatatatataacttttcaaaaaattgttatacttgtttcatttttaccttcacaactattttcccaattaggtaaaggattattgttttcattatacgactctacagaaaggacattgaactcattaacatagcagactccaaattatgtggttaaaataaagctaatataaccaggga

SEQ ID NO: 337494 - DNA, 456 bp, Homo sapiens
cctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacc

SEQ ID NO: 337495 - DNA, 134 bp, Homo sapiens
ggaaagccccattgcagccgcaaccctgtccttgtcagaggaattggcaggtattgccgatctgccatgtattccagaaaggccatgtacaagaggaagtactcagccgctaaatctaaggttgaaaagaaaaa

SEQ ID NO: 337496 - DNA, 228 bp, Homo sapiens
agctgctgagtggtgcttcctgacaaggtctacatagctgagacccaggcgcgagcgacaatcaccctgccctgcaaatccatagaaccctgaactggtgggaggacaccagcttgtgaactaggaaaaggttgggtgcccatgggtcatggctggactgcccactctgcagcaagaaaccaggatgcaagcaacaggtggagataggcaccagcagaacaggcatcc

SEQ ID NO: 337497 - DNA, 134 bp, Homo sapiens
ctgggcaaagcaaaatgaaaagcaatttaaaagacaagaaaaattaacattctgatcatctctttaagaactgtatctgaaaatattttgccttaagaactctgtttaataccagtgctgaactctccctaact

SEQ ID NO: 337498 - DNA, 233 bp, Homo sapiens
ccagaaatatcacatgcagccccacaacctatagattgtccattcctgctgtctgtgctttttttcaggatgaggagagttttggaggtagaagaagatgaagtggtcagaggatgggactcaggaggggacagggtaataaatatggtatgaaagttgctgcatttaaagagcttagggccgggcgccatggctcacgcctgtaatcctagcacttttggaggccaaggtgt

SEQ ID NO: 337499 - DNA, 748 bp, Homo sapiens
ttttttttttcacttaatgttgtttttgtttaacttttgacattcatatgatcatatatacagtgttattccttagtcttaaaattatagacaacttgtaaagaattcaagaggatgatttatgtctggggactcttcgtgtcacgtatcttggtggcttaatatagaagagtcaaagtaacatgggcttttatgattggtttgataggataccatgacaatcatattgtaattcggtggttctgggctgcagtggaaagattcaacaatgaacaacgactaaggttgttacaggtgagatgccattatttaatcttttaaatgtatcaatatgattattgttggaagtgtatgtttttaataactgctaactattctccataaacacataccatgtgtatctggaaatatgagatacaccatttccagactcctgattgcatggttatgtgactccatggctattcagaacttccctaagccaaattaaagcatttcatgagagtttagggaagtgtcaagtccagtccaagaatcccagtaacaacatctgccttcaggacagcttggacccttcagcaagaaggacccagggtacccaaagtgcaggccggcatccctagcagcagaaagaaatgattttaagttctttaaaaagggatgcagttagttgacagtcctttcttctctttcatctaactttccacaaatttgagaaaacagtgacatttcaagaacagtgggaaaa

SEQ ID NO: 337500 - DNA, 759 bp, Homo sapiens
ctagttaattgtggcaaatggaaatgttctagaaagataagtaaattatctttaatagtatagtaataatttgtattttctaaattgtctctttatggacaggttaattatccgaagagatcacttactagaagatgcttttaatcagattatgggctactccagaaaagacctgcagagaaataagctatatgtcaccttcgttggggaggaagggtgagtagaacagagaagtggcctgtggaacataggctgtggccacaaggcggatgtttctccacgtcgctgtggttgcctgaaacagttttaaaggtctcctctggcttttaaatcacttgacatagaaatcctttagtaaaaacttgtagctttagatcatttttgagaacagaagcctagtttagtttcttctctccggacctctctttctcttaaagggaaaaagtaaggctttacaaggaaaaaaaacaaggaattgcatttatgcaattcctttgtgatctgtgatcttattttctaccctgcagggctaggtagaacgtgcttcctctattaaataagttcagtttcagaaacatgaattagaatcttgctgttctacccagaagcctccacagaagtaactcttgggccttggctcttatttctctgcctccagtttttctcttcccttgggaaggcagcacacctaccaacattactacctaacataaacaaacatgtcccgccttccatgactcttccatgagtgtgctcgtc

SEQ ID NO: 337501 - DNA, 4134 bp, Homo sapiens
  misc_feature (827)..(827): n is a, c, g, or t
taagtttcaaggtggtaagaactttataataaccacatatgacagtaagagctcaaagaccatcagttaagagaagcctaaatgtccattcttctggcttccttcttggatcatgtctttggtgactatctcgtggagtatttcctaaaaccaggcataatgttccttcctgctctcttcgttctggatctcatctaagcttggctttctctaatctgatctgtcctgtgtgggtaaggagaaatttccccaaagattgaaaattatgagaaaatagagctaagattgtgactcagaagtgagtcttttcctgaccgtctgatgttataagtcagctaagacatgtgagcggcatgtatttgactcagtgtattgtatcctaggcattctttgtggaccacaactcccgcaccaccactttcattgatccccggctcccacttcagagcagtagacccacaagtgcgctggttcatcggcaacacctgacaaggcaacgcagccacagtgcgggtgaggtaggagaagattctcgacatgcaggaccaccagttcttcccaggccatccagtacattcaatacagtcagtaggccacagtaccaggacatggttccagtggcttacaatgacaagattgttgcatttctacgtcaacccaatatctttgaaattctacaggagcgtcaacctgatcttaccaggaatcactcactcagggagaagatccaatttatccgaactgaagggactccaggattggtgcgcctttcaagcgatgcagaccttgttatgttgctgagcttatttgaagaagagataatgtcntatgtgcctccacatgccttactccaccccagctactgtcagtccccacgtggctctcccgtgtcatctcctcagaactcgccaggtacccagcgtgccaatgcccgggctccagccccttacaagcgggatttcgaagccaaactgaggaacttttacaggaagttagagactaaaggatatggacaaggcccagggaagttaaagttaattatccgaagagatcacttactagaagatgcttttaatcagattatgggctactccagaaaagacctgcagagaaataagctatatgtcaccttcgttggggaggaagggctggattacagtgggccttctagagagtttttcttcctggtatccagagaactctttaacccatattatggcttatttgaatattcagccaatgacacatacacagtacaaataagtcctatgtctgcttttgtagacaatcaccatgaatggttccgattcagtggtaggatccttggtcttgcactaatacaccagtatttgttggatgccttcttcacacggcccttttataaggctcttctcagaattctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgaggtggtggatgccaggctggtatctgtttttgatgcaagagaactggaattggtcatcgcaggcacagctgaaatagacctaagtgattggagaaacaacacagaatatagaggaggataccatgacaatcatattgtaattcggtggttctgggctgcagtggaaagattcaacaatgaacaacgactaaggttgttacagtttgttacaggcacatccagcattccctatgaaggatttgcttcactccgagggagtaacggcccaagaagattctgtgtggagaaatgggggaaaatcactgctcttcccagagcgcatacatgttttaaccgtctggatctgcctccctacccatccttttccatgctttatgaaaaactgttgacagcagttgaagaaaccagtacttttggacttgagtgacctggaagctgaatgcccatctctgtggacaggcagtttcagaagctgccttctagaagaatgattgaacattggaagtttcaagaggatgcttcctttaggataaagctacgtgctgttgttttccaggaacaagtgctctgtcacatttggggactggagatgagtcctcttggaaggatttgggtgagcttgatgcccagggaacaacccaaccgtctttcaatcaacagttcttgactgccaaactttttccatttgttatgttccaagacaaagatgaacccatacatgatcagctccacggtaatttttagggactcaggagaatcttgaaacttacccttgaacgtggttcaagccaaactggcagcatttggcccaatctccaaattagagcaagttaaataatataataaaagtaaatatatttcctgaaagtacattcatttaagccctaagttataacagaatattcatttcttgcttatgagtgcctgcatggtgtgcaccataggtttccgctttcatgggacatgagtgaaaatgaaaccaagtcaatatgaggtacctttacagatttgcaataagatggtctgtgacaatgtatatgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggctcattatgtttatgttctttaagatgtatataagaacctacctatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactccatcacttgagaagtataatagaaaatagcttctaaatcaaacttccttcacagtgccgtgtctaccactacaaggactgtgcatctaagtaataattttttaagattcactatatgtgatagtatgatatgcatttatttaaaatgcattagactctcttccatccatcaaatactttacaggatggcatttaatacagatatttcgtatttcccccactgctttttatttgtacagcatcattaaacactaagctcagttaaggagccatcagcaacactgaagagatcagtagtaagaattccattttccctcatcagtgaagacaccacaaattgaaactcagaactatatttctaagcctgcattttcactgatgcataattttcttattaatattaagagacagtttttctatggcatctccaaaactgcatgacatcactagtcttacttctgcttaattttatgagaaggtattcttcattttaattgcttttgggattactccacatctttgtttatttcttgactaatcagattttcaatagagtgaagttaaattgggggtcataaaagcattggattgacatatggtttgccagcctatgggtttacaggcattgcccaaacatttctttgagatctatatttataagcagccatggaattcctattatgggatgttggcaatcttacattttatagaggtcatatgcatagttttcataggtgttttgtaagaactgattgctctcctgtgagttaagctatgtttactactgggaccctcaagaggaataccacttatgttacactcctgcactaaaggcacgtactgcagtgtgaagaaatgttctgaaaaagggttatagaaatctggaaataagaaaggaagagctctctgtattctataattggaagagaaaaaaagaaaaacttttaactggaaatgttagtttgtacttattgatcatgaatacaagtatatatttaattttgaaaaaaaat

SEQ ID NO: 337502 - DNA, 1690 bp, Homo sapiens
  misc_feature (827)..(827): n is a, c, g, or t
taagtttcaaggtggtaagaactttataataaccacatatgacagtaagagctcaaagaccatcagttaagagaagcctaaatgtccattcttctggcttccttcttggatcatgtctttggtgactatctcgtggagtatttcctaaaaccaggcataatgttccttcctgctctcttcgttctggatctcatctaagcttggctttctctaatctgatctgtcctgtgtgggtaaggagaaatttccccaaagattgaaaattatgagaaaatagagctaagattgtgactcagaagtgagtcttttcctgaccgtctgatgttataagtcagctaagacatgtgagcggcatgtatttgactcagtgtattgtatcctaggcattctttgtggaccacaactcccgcaccaccactttcattgatccccggctcccacttcagagcagtagacccacaagtgcgctggttcatcggcaacacctgacaaggcaacgcagccacagtgcgggtgaggtaggagaagattctcgacatgcaggaccaccagttcttcccaggccatccagtacattcaatacagtcagtaggccacagtaccaggacatggttccagtggcttacaatgacaagattgttgcatttctacgtcaacccaatatctttgaaattctacaggagcgtcaacctgatcttaccaggaatcactcactcagggagaagatccaatttatccgaactgaagggactccaggattggtgcgcctttcaagcgatgcagaccttgttatgttgctgagcttatttgaagaagagataatgtcntatgtgcctccacatgccttactccaccccagctactgtcagtccccacgtggctctcccgtgtcatctcctcagaactcgccaggtacccagcgtgccaatgcccgggctccagccccttacaagcgggatttcgaagccaaactgaggaacttttacaggaagttagagactaaaggatatggacaaggcccagggaagttaaagttaattatccgaagagatcacttactagaagatgcttttaatcagattatgggctactccagaaaagacctgcagagaaataagctatatgtcaccttcgttggggaggaagggtgagtagaacagagaagtggcctgtggaacataggctgtggccacaaggcggatgtttctccacgtcgctgtggttgcctgaaacagttttaaaggtctcctctggcttttaaatcacttgacatagaaatcctttagtaaaaacttgtagctttagatcatttttgagaacagaagcctagtttagtttcttctctccggacctctctttctcttaaagggaaaaagtaaggctttacaaggaaaaaaaacaaggaattgcatttatgcaattcctttgtgatctgtgatcttattttctaccctgcagggctaggtagaacgtgcttcctctattaaataagttcagtttcagaaacatgaattagaatcttgctgttctacccagaagcctccacagaagtaactcttgggccttggctcttatttctctgcctccagtttttctcttcccttgggaaggcagcacacctaccaacattactacctaacataaacaaacatgtcccgccttccatgactcttccatgagtgtgctcgtc

SEQ ID NO: 337503 - DNA, 493 bp, Homo sapiens
tagaatataaatttctttaatttcttgatctgtgggatactggaaaaagaatcagatcatttaaaatacgtaagaatgcattaaaatgttcatagtaactagaaatattacttaactgaattttagtgtaattaagaacagccatgttttatgtatgaatttacagcaaagaaaaaagcattgggggattaaaatgatgacacatgatgtaggtatcctatgattcttttgaaatgcagactgaagtgagtagatagttttcacatcatagaaagatttccctgaccgcctctgtggtctgccccatctagatttccgacgggagaacatcctgcctcactctacctccagatccaggatcacgttgctgttacagtctccccccgtgaagttcctcatcagcccagagttcttcaccgtgctgcattctaaccctgtgagtagcgaatctgaaagagtgtgaaggaaaacagcaggccaaagcaaatgatcg

SEQ ID NO: 337504 - DNA, 6934 bp, Homo sapiens
  misc_feature (95)..(95): n is a, c, g, or t
  misc_feature (1476)..(1476): n is a, c, g, or t
  misc_feature (3627)..(3627): n is a, c, g, or t
atttgagcatcagttgagggagaggacgcttcatttcctttttggttgggaatgtgccgtgaacatcctctgctggagcttggggcctggagcanactggggctgcagatttagacgtagacgtttccgaggacgcgagactgcagagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaagggcaaattgtatggagaattgagcctgggccctatttcatggaaccggagataaaaatctgttttaaatattaccacggcattagtggagccctgcgagccacgaccccctgcatcaccgtgaagaacccagctgtgatgatgggggcagaaggcatggagggaggtgcttcaggaaacctgcattctcgaaaacttgttagctttacattgtcagatcttagggcagttgggctaaagaaagggatgttcttcaatcctgacccttatcttaagatgtcaattcagccaggaaagaagagcagtttccccacctgtgcccaccacgggcaggagagacggtctactatcatcagtaacaccaccaatccaatttggcaccgagagaaatattccttttttgcacttcttactgatgtcttagaaattgaaattaaagacaaatttgccaagagccgtcccatcatcaagcgttttctggggaaactaaccattccagtccagaggctgctggagcgacaagccatcggtgatcaaatgctcagctacaaccttggcagaaggctcccagctgaccacgtgagtgggtacctccagtttaaagtggaggttacgtcttctgttcatgaagatgcctctccagaagctgttggcacaatacttggagtcaattctgtgaatggagacttaggtagcccttccgatgacgaggacatgccagggagccatcacgacagccaggtgtgctctaatgggccagtttctgaggacagtgctgccgatggaacccccaagcattcattcaggactagctccactctggaaatagacacagaggaattaacctctacgtcttcaaggacctcacctcccagaggacgtcaggattcactcaatgattacttagatgctatcgaacacaatggccactccaggccngggacagcgacctgctctgagaggtccatgggtgcctctccgaaactgaggagtagttttcccactgacacaagactcaatgccatgcttcatattgattcagatgaagaagatcacgagttccagcaagacctgggttacccatcttccttggaggaggagggaggcctgatcatgtttagcagggcatccagagctgatgatggaagcctgacatctcagacaaagctggaggacaaccctgttgagaatgaggaagcctccacacacgaagctgcttcctttgaggataagccagaaaatcttccagagcttgcagagagctccttacctgcaggcccagccccagaggaaggtgaaggcggcccagagcctcaacccagtgctgaccagggcagtgctgaactgtgtggctctcaagaggtagatcagcccacaagtggcgcagacacagggacttccgatgcatcaggaggaagccgaagagccgtcagtgagaccgagtctctcgatcagggctctgagccttcccaggtgtcctctgaaacagaacccagtgatcctgccaggacagagagtgtgagcgaagccagcaccaggcctgagggagagagtgacctggaatgcgctgacagctcctgcaatgagagtgtgaccacgcagctgtcctctgtggacacacggtgctcctctcttgagagcgcacggtttcctgaaaccccagccttttcttctcaggaggaggaagacggagcctgtgcagcagagcccaccagcagtggccctgccgaagggtcgcaggaatccgtgtgcactgctggttctttacctgtggtacaggtgcccagtggggaggatgaagggccaggggcagaatcggccactgtacctgaccaggaggagctgggggaggtctggcagcggagggggagcctggagggagctgcagctgctgccgagagcccaccgcaagaagaaggcagtgctggggaggcccaaggcacctgtgaaggggcaactgcccaggaggagggcgctactggaggttctcaagccaacggccaccagccactgcgatcactaccttcagtgcgccaggatgttagccggtaccagagggtggacgaggctctcccaccaaactgggaggcacgcattgacagccacggcaggatcttctacgtggatcacgtaaacagaaccacgacgtggcagcgaccgacagctcccccagccccgcaggtgctgcagagatctaactccatacagcaaatggagcagctgaaccggcgatatcagagtatccgcagaaccatgaccaatgagaggcctgaggaaaataccaatgctattgatggggcaggggaggaagctgactttcaccaagccagtgcagatttccgacgggagaacatcctgcctcactctacctccagatccaggatcacgttgctgttacagtctccccccgtgaagttcctcatcagcccagagttcttcaccgtgctgcattctaaccctagtgcctaccgcatgtttacaaacaacacgtgtttgaagcacatgatcaccaaagtccggagggacacccaccactttgaacgctaccagcataaccgcgaccttgtgggattcctcaacatgttcgcgaacaaacagctagagctgccgcggggatgggaaatgaaacatgatcaccagggcaaggcattctttgtggaccacaactcccgcaccaccactttcattgatccccggctcccacttcagagcagtagacccacaagtgcgctggttcatcggcaacacctgacaaggcaacgcagccacagtgcgggtgaggtaggagaagattctcgacatgcaggaccaccagttcttcccaggccatccagtacattcaatacagtcagtaggccacagtaccaggacatggttccagtggcttacaatgacaagattgttgcatttctacgtcaacccaatatctttgaaattctacaggagcgtcaacctgatcttaccaggaatcactcactcagggagaagatccaatttatccgaactgaagggactccaggattggtgcgcctttcaagcgatgcagaccttgttatgttgctgagcttatttgaagaagagataatgtcntatgtgcctccacatgccttactccaccccagctactgtcagtccccacgtggctctcccgtgtcatctcctcagaactcgccaggtacccagcgtgccaatgcccgggctccagccccttacaagcgggatttcgaagccaaactgaggaacttttacaggaagttagagactaaaggatatggacaaggcccagggaagttaaagttaattatccgaagagatcacttactagaagatgcttttaatcagattatgggctactccagaaaagacctgcagagaaataagctatatgtcaccttcgttggggaggaagggctggattacagtgggccttctagagagtttttcttcctggtatccagagaactctttaacccatattatggcttatttgaatattcagccaatgacacatacacagtacaaataagtcctatgtctgcttttgtagacaatcaccatgaatggttccgattcagtggtaggatccttggtcttgcactaatacaccagtatttgttggatgccttcttcacacggcccttttataaggctcttctcagaattctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgaggtggtggatgccaggctggtatctgtttttgatgcaagagaactggaattggtcatcgcaggcacagctgaaatagacctaagtgattggagaaacaacacagaatatagaggaggataccatgacaatcatattgtaattcggtggttctgggctgcagtggaaagattcaacaatgaacaacgactaaggttgttacagtttgttacaggcacatccagcattccctatgaaggatttgcttcactccgagggagtaacggcccaagaagattctgtgtggagaaatgggggaaaatcactgctcttcccagagcgcatacatgttttaaccgtctggatctgcctccctacccatccttttccatgctttatgaaaaactgttgacagcagttgaagaaaccagtacttttggacttgagtgacctggaagctgaatgcccatctctgtggacaggcagtttcagaagctgccttctagaagaatgattgaacattggaagtttcaagaggatgcttcctttaggataaagctacgtgctgttgttttccaggaacaagtgctctgtcacatttggggactggagatgagtcctcttggaaggatttgggtgagcttgatgcccagggaacaacccaaccgtctttcaatcaacagttcttgactgccaaactttttccatttgttatgttccaagacaaagatgaacccatacatgatcagctccacggtaatttttagggactcaggagaatcttgaaacttacccttgaacgtggttcaagccaaactggcagcatttggcccaatctccaaattagagcaagttaaataatataataaaagtaaatatatttcctgaaagtacattcatttaagccctaagttataacagaatattcatttcttgcttatgagtgcctgcatggtgtgcaccataggtttccgctttcatgggacatgagtgaaaatgaaaccaagtcaatatgaggtacctttacagatttgcaataagatggtctgtgacaatgtatatgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggctcattatgtttatgttctttaagatgtatataagaacctacctatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactccatcacttgagaagtataatagaaaatagcttctaaatcaaacttccttcacagtgccgtgtctaccactacaaggactgtgcatctaagtaataattttttaagattcactatatgtgatagtatgatatgcatttatttaaaatgcattagactctcttccatccatcaaatactttacaggatggcatttaatacagatatttcgtatttcccccactgctttttatttgtacagcatcattaaacactaagctcagttaaggagccatcagcaacactgaagagatcagtagtaagaattccattttccctcatcagtgaagacaccacaaattgaaactcagaactatatttctaagcctgcattttcactgatgcataattttcttattaatattaagagacagtttttctatggcatctccaaaactgcatgacatcactagtcttacttctgcttaattttatgagaaggtattcttcattttaattgcttttgggattactccacatctttgtttatttcttgactaatcagattttcaatagagtgaagttaaattgggggtcataaaagcattggattgacatatggtttgccagcctatgggtttacaggcattgcccaaacatttctttgagatctatatttataagcagccatggaattcctattatgggatgttggcaatcttacattttatagaggtcatatgcatagttttcataggtgttttgtaagaactgattgctctcctgtgagttaagctatgtttactactgggaccctcaagaggaataccacttatgttacactcctgcactaaaggcacgtactgcagtgtgaagaaatgttctgaaaaagggttatagaaatctggaaataagaaaggaagagctctctgtattctataattggaagagaaaaaaagaaaaacttttaactggaaatgttagtttgtacttattgatcatgaatacaagtatatatttaattttgaaaaaaaat

SEQ ID NO: 337505 - DNA, 2551 bp, Homo sapiens
ttttttttttcacttaatgttgtttttgtttaacttttgacattcatatgatcatatatacagtgttattccttagtcttaaaattatagacaacttgtaaagaattcaagaggatgatttatgtctggggactcttcgtgtcacgtatcttggtggcttaatatagaagagtcaaagtaacatgggcttttatgattggtttgataggataccatgacaatcatattgtaattcggtggttctgggctgcagtggaaagattcaacaatgaacaacgactaaggttgttacagtttgttacaggcacatccagcattccctatgaaggatttgcttcactccgagggagtaacggcccaagaagattctgtgtggagaaatgggggaaaatcactgctcttcccagagcgcatacatgttttaaccgtctggatctgcctccctacccatccttttccatgctttatgaaaaactgttgacagcagttgaagaaaccagtacttttggacttgagtgacctggaagctgaatgcccatctctgtggacaggcagtttcagaagctgccttctagaagaatgattgaacattggaagtttcaagaggatgcttcctttaggataaagctacgtgctgttgttttccaggaacaagtgctctgtcacatttggggactggagatgagtcctcttggaaggatttgggtgagcttgatgcccagggaacaacccaaccgtctttcaatcaacagttcttgactgccaaactttttccatttgttatgttccaagacaaagatgaacccatacatgatcagctccacggtaatttttagggactcaggagaatcttgaaacttacccttgaacgtggttcaagccaaactggcagcatttggcccaatctccaaattagagcaagttaaataatataataaaagtaaatatatttcctgaaagtacattcatttaagccctaagttataacagaatattcatttcttgcttatgagtgcctgcatggtgtgcaccataggtttccgctttcatgggacatgagtgaaaatgaaaccaagtcaatatgaggtacctttacagatttgcaataagatggtctgtgacaatgtatatgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggctcattatgtttatgttctttaagatgtatataagaacctacctatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactccatcacttgagaagtataatagaaaatagcttctaaatcaaacttccttcacagtgccgtgtctaccactacaaggactgtgcatctaagtaataattttttaagattcactatatgtgatagtatgatatgcatttatttaaaatgcattagactctcttccatccatcaaatactttacaggatggcatttaatacagatatttcgtatttcccccactgctttttatttgtacagcatcattaaacactaagctcagttaaggagccatcagcaacactgaagagatcagtagtaagaattccattttccctcatcagtgaagacaccacaaattgaaactcagaactatatttctaagcctgcattttcactgatgcataattttcttattaatattaagagacagtttttctatggcatctccaaaactgcatgacatcactagtcttacttctgcttaattttatgagaaggtattcttcattttaattgcttttgggattactccacatctttgtttatttcttgactaatcagattttcaatagagtgaagttaaattgggggtcataaaagcattggattgacatatggtttgccagcctatgggtttacaggcattgcccaaacatttctttgagatctatatttataagcagccatggaattcctattatgggatgttggcaatcttacattttatagaggtcatatgcatagttttcataggtgttttgtaagaactgattgctctcctgtgagttaagctatgtttactactgggaccctcaagaggaataccacttatgttacactcctgcactaaaggcacgtactgcagtgtgaagaaatgttctgaaaaagggttatagaaatctggaaataagaaaggaagagctctctgtattctataattggaagagaaaaaaagaaaaacttttaactggaaatgttagtttgtacttattgatcatgaatacaagtatatatttaattttgaaaaaaaat

SEQ ID NO: 337506 - DNA, 276 bp, Homo sapiens
agttcgacggagactctcccttgactcagaaaaaaaaaagtacactacgagaagttagaaactttatggttaagcagcagattagacttctccctaaagggagaatgaactgggaaatagatctgaagttacacagagagagcactgacatacagagaagtggaaactaaggaaaagaggttaaaaaacatggaagaggctgggtgtagttgctgacacctgtaatcccaacttttggggaggcatagagagtctccgtcgaacggggtaccgagc

SEQ ID NO: 337507 - DNA, 338 bp, Homo sapiens
gggcaacataaggagaccttgtctctaaaaaaaaattaaaaaatcagacatgtggcacatgcctatagtcccagcttctctggaggctcaggctggaggattgcttgaccccaggaacttgaggttgcagtgagctatgatggcatcactgcactccagcctgggtgacagagcaagatcctgtctataaaacaacaaaatgaagataaatgtgagacttgacaatcaaaatttcaggaaagaatatttcaaagaggctgggcattttctagaattttttttgagatggggtctccctctgcactccagcctggagtgcagtggcacgatcttggctc

SEQ ID NO: 337508 - DNA, 507 bp, Homo sapiens
tgggcaacaagagtgatactccacctcagaaaaaaaaaagtacactacgagaagttagaaactttatggttaagcagcagattagacttctccctaaagggagaatgaactgggaaatagatctgaagttacacagagagagcactgacatacagagaagtggaaactaaggaaaagaggttaaaaaacatggaagaggctgggtgtagttgctgacacctgtaatcccaacttttggggaggcatagagaggactgcttgaggtcctcagttggggaccagcctgggcaacataaggagaccttgtctctaaaaaaaaattaaaaaatcagacatgtggcacatgcctatagtcccagcttctctggaggctcaggctggaggattgcttgaccccaggaacttgaggttgcagtgagctatgatggcatcactgcactccagcctgggtgacagagcaagatcctgtctataaaacaacaaaatgaagataaatgtgagacttga

SEQ ID NO: 337509 - DNA, 400 bp, Homo sapiens
atgaagtgctgggattacaggcacgagccactgcacccagcctctagaacataggctttcattactattctccagattacatattttgactgacctaaatcatatatgtagagtaaaaacaaattttatctaaataaacttattggacttcattcaaagagaaattgtttccttgggcagttttgctcccaacattagatcccgcattctcaggacagctgtcatctttttaatttagttttctgattttatttttatttattttgttactccaacctttgctttggcctttaacaactcagtgttttggtctaatcttcaagaggaatttgaggttcacttgaataagttagactagtttgaggtgggtgtagctagaggattgaagtcgtaccaaaaa

SEQ ID NO: 337510 - DNA, 759 bp, Homo sapiens
atcacttgtgtgttccctggagtagcacttttaatttccttcaagaactttccctttgcactcacaacttggctaactgctcaggacaagaggtctagctttcggtctgtcttggcttttgctgttctcactaagcataatcagagagatgtatgactcttcctttcagttgaagactcacaatctactctagggttattaattggcctagtttcaatattgctgtttctcagggaatagggaggcccaagaagaagggagacgggaataaccaattggttgagttgttagaacacccatgacatttatcgatgaagttcactgtctaatatggtttggctgtgtccccacccaaatctcatcttgaattgtagctcccatcattcccacgtgttgtaggagggaactggtgggagataattgaatcatgggggcagttgccctcatactgttctcatggtagtgaataagtctcatgagatctgatggttttataaggggtttccactttcacttggttctcattctctcttgcctgccgccatgtaagatgtgccttttgcattctgccatgattatgaggcctccccagccaccaggaactgtgagtccattaaacttctttttctttataaattatccagtcttgggtatctttatcaacagtatgaaaatgaactaataggctgggcgcagtggctcacgcctgtaatcccagcactttgggaggctgaggcaggcagatcatgaggtcaggag

SEQ ID NO: 337511 - DNA, 334 bp, Homo sapiens
gtgtggtgactcacgcctgtaataccatctctttgggaggccaaggtgggcagatcacctgaggtctggagtttgagaccagcctagccaacatggtgaaaccccgtctctactaaaaaatacaaaaataaaattagccaggcccagtggcttgtgcctgtagtcccatctccttgggaggctgaggcaggagaattgcttgaacccagaaggcagtgagatgagattgtgccactgcactccggtgatagagtgagactccgtttcaaaaatcaacaacaacaaagaaaaacaaaaaaccatgagttcatacaagtatctctagttctaatct

SEQ ID NO: 337512 - DNA, 467 bp, Homo sapiens
gcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacc

SEQ ID NO: 337513 - DNA, 255 bp, Homo sapiens
tgggaaagagagtgggagagggcagaacaaacactttaatcagtacagcatatttagatctggcacctacatcagaataacactgatgcaacaatatttataccaattgaaaatgctggggcagtgaacacttctgttccgattcttttttaacacggtccacctaccttcaatacaatttaaagtaattacaaacaatttgaaaaatcaacatgggcagggaacagttttctcattgtgttactgaggtgtggg

SEQ ID NO: 337514 - DNA, 616 bp, Homo sapiens
aataaactgtggtctgcataaatgacgaaatactgttcagccttaaaaaagaagaaaattctacaggatgaaacaatatggataaacctggaggaaattaaatgaggtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataaccctggcctcgttggcctcagcggtggagctctgccggccggaa

SEQ ID NO: 337515 - DNA, 733 bp, Homo sapiens
aataaactgtggtctgcataaatgacgaaatactgttcagccttaaaaaagaagaaaattctacaggatgaaacaatatggataaacctggaggaaattaaatgagaagacaagctaagatgcaagaaaatgtgacccttgataaagatggaaaacaggaaatgaaagtgtaccaggagagccacaaaagttccaggagttccagatgttctttttctttcccccggccagggatctgaaactaactcggacttacttgaaaaggtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataaccc

SEQ ID NO: 337516 - DNA, 529 bp, Homo sapiens
aatgtaaattgaaacggaagccattagttagaaggaagaagggagggcttttagtggatagtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataaccc

SEQ ID NO: 337517 - DNA, 762 bp, Homo sapiens
cctgactttcttatggtgaagacgtaggcttcccctgtggaagatgcagcaacaaggcaacaacttggaagctcagactggaccctcaccaaacactaatcctgccagcaatttatcttgggttttcagtctccagaactgtgagaactaaatttctgttatttgtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataacccataaccctcaaactttcaccataaatctttttctttttagcaacaatatctgaaacacttctgtacacttgatttttaagtgtacaatgacatacacattggaataaaatgaatgagaaatccccatac

SEQ ID NO: 337518 - DNA, 1000 bp, Homo sapiens
  misc_feature (163)..(163): n is a, c, g, or t
tctgcgcgcctcgaacggcactcccaccctggacacccacttctctcggaggatgcgcaccccgcggcgtaccgcggtccctcccccccgcctccactccccacgccgtccgcccgcgcttcaccacccgcgggccccgccccgccacggtcccactcccctnttttatccaccgccacggacgggcttatcgcctcctaagggcaattgggccgggcccccccccaggtgggggatttataagctcctatggccataacgcccatcccgtttaattgttacccagcagtggctctgccacaccattttggactttagctccagtgcctctcttaataacccccgccccagattcaagtacaaaatcaacaaaccaaagtataggtggaaaatataccacgtgagtttctcagacaccgtttgaatggagactggcatctctttaagaactacttccctttctccacagcttaacatcagaaacttgaaggtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataaccctggcctcgttggcctcagcggtggagctctgccggccggaa

SEQ ID NO: 337519 - DNA, 774 bp, Homo sapiens
aataaactgtggtctgcataaatgacgaaatactgttcagccttaaaaaagaagaaaattctacaggatgaaacaatatggataaacctggaggaaattaaatgagaagacaagctaagatgcaagaaaatgtgacccttgataaagatggaaaacaggaaatgaaagtgtaccaggagagccacaaaagttccaggagttccagatgttctttttctttcccccggccagggatctgaaactaactcggacttacttgaaaaggtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataaccctggcctcgttggcctcagcggtggagctctgccggccggaa

SEQ ID NO: 337520 - DNA, 959 bp, Homo sapiens
  misc_feature (163)..(163): n is a, c, g, or t
tctgcgcgcctcgaacggcactcccaccctggacacccacttctctcggaggatgcgcaccccgcggcgtaccgcggtccctcccccccgcctccactccccacgccgtccgcccgcgcttcaccacccgcgggccccgccccgccacggtcccactcccctnttttatccaccgccacggacgggcttatcgcctcctaagggcaattgggccgggcccccccccaggtgggggatttataagctcctatggccataacgcccatcccgtttaattgttacccagcagtggctctgccacaccattttggactttagctccagtgcctctcttaataacccccgccccagattcaagtacaaaatcaacaaaccaaagtataggtggaaaatataccacgtgagtttctcagacaccgtttgaatggagactggcatctctttaagaactacttccctttctccacagcttaacatcagaaacttgaaggtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataaccc

SEQ ID NO: 337521 - DNA, 1088 bp, Homo sapiens
  misc_feature (163)..(163): n is a, c, g, or t
tctgcgcgcctcgaacggcactcccaccctggacacccacttctctcggaggatgcgcaccccgcggcgtaccgcggtccctcccccccgcctccactccccacgccgtccgcccgcgcttcaccacccgcgggccccgccccgccacggtcccactcccctnttttatccaccgccacggacgggcttatcgcctcctaagggcaattgggccgggcccccccccaggtgggggatttataagctcctatggccataacgcccatcccgtttaattgttacccagcagtggctctgccacaccattttggactttagctccagtgcctctcttaataacccccgccccagattcaagtacaaaatcaacaaaccaaagtataggtggaaaatataccacgtgagtttctcagacaccgtttgaatggagactggcatctctttaagaactacttccctttctccacagcttaacatcagaaacttgaaggtcactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgtgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaataaagatgctataacccataaccctcaaactttcaccataaatctttttctttttagcaacaatatctgaaacacttctgtacacttgatttttaagtgtacaatgacatacacattggaataaaatgaatgagaaatccccatac

SEQ ID NO: 337522 - DNA, 231 bp, Homo sapiens
taggggtggtggtgtgacctgcctggagcagcgctaagtatggacttgtgagtcaagggctatcaaaacctaagtaaactgattgctgttcagagaaggtagagttccattccacagtttgcaagaaggactgttttatggaggaggtcatgttggactagaccttaaaaagttggtagaatttaaaagcaaggatatggaagcaggaagagtgaaagtgagcagaggtac

SEQ ID NO: 337523 - DNA, 116 bp, Homo sapiens
caaattattctggcttgatgtccatctgatggtttactcttgctacctcctactccctactataaccacaaatgacctcctccccacttgctctcattcttaccagaagttttcag

SEQ ID NO: 337524 - DNA, 694 bp, Homo sapiens
tggagaatgggaatggcaggatctgcctggtagcttagagggatcatgctggctgccatgagaaaaacagacaaggctggggcaaagaggaaaataaactgcaggcatgtcttgcaggcatgtgtctcggatagatgcttggttcaaccaacctggtggtggtagaggaggttagcagtggtcagatgggattttcagagggctcaaactggtggcatcacagaagctgaagtgtgaggagtgaggcatgatcagaatgcaagcatagagttgtcccacgctggtggataccttgcctctcagacgctctgtgatgtgcatggcagaatccagccactgagtgatggactctgaattattaagcgaacatgagagcctctttgatccagagcgtatcttcacatcttacaattaggaaatagtggccaaaagatgccaaaaagtgtaatgtgtccagcaggtcaattatatttgggtttccaacaaacaagaagcaggtatattgctctcatttctccaggctggcagatatgtacagcagttctcccttatctgtggtttctctttccactgtttcagttacccatggtcaaccaaggtccaaagatactaaatagtgacagaaataaacatttcataagtttcagattgtgtggcgtacttaagtgtgatgcatctagcgtcctgcttggcc

SEQ ID NO: 337525 - DNA, 402 bp, Homo sapiens
tcagtgaatgtagaagaaatatgtaaaacaattacattttagaagtagaaaaggaaaggaacctaaatggaagtaaggtttctacacttcaaagtatcatatatgtacattgtgatacccatataaccactaagaaaactatccaaaatgagatacagaaaaacgttagaaataaatcacaacggacttctaaaaaatactcaacctataggaagataagaaaagagagaataataagaatataggaaaataataaaatggcacgtttaacatgcatatcaataattatgttaaatgtaacagatctaaatataccaattaaaatacctagatttatagaatgaatgaaaaaaatgacctaataatatactgtctacaagaagctcacttaaagtgcaatga

SEQ ID NO: 337526 - DNA, 554 bp, Homo sapiens
atatgcatgatgagaatcaaggaaggaaagagaaggacagaaaaaataattggagaaataacagcccaaaatttcccatgtgatagaaaacattacacatccaagaggctcaacgaattacaagataaactaaaagagattcacatcaagatacatcaaatcaaatgattaaaagccaataaaaataagaaaatcttgaaaacatcaaagagaagcaattcatcacatactaaggatcctcccaaagcagctgacttttcatcagaaaacatggcagcagtgggatatattcaaagtgctgaaagaaaagagattgtctatatccaacaaaactatcctttaaaaatgaaggagaaattaaattattcccatattaaaacagaaaagaacttcttgctaacagacttaccctaaagaaatactaaagggagtctttcaggctaaaatataaacacaccagagagtaattcaaatccacctaaaaaataaagagagagaggtggtggtgtcgcaaataaggtggtgggcagataaggtggtgggcagataaggtg

SEQ ID NO: 337527 - DNA, 178 bp, Homo sapiens
ctcatcagttgccacttaagcatatctgattcttaaaaatttgaatattcaagaacaaattgtaaaaatattccttgtataatttttggttttgtagtaattcctttgtttgcttcacagtacttctgcagagtgatccatttgtaattaatagacacacacacatcatccaccattg

SEQ ID NO: 337528 - DNA, 1691 bp, Homo sapiens
  misc_feature (1550)..(1550): n is a, c, g, or t
  misc_feature (1599)..(1599): n is a, c, g, or t
  misc_feature (1690)..(1690): n is a, c, g, or t
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaagtaagtaatattagaactttgaagaaaaatgcttttgttctgttaggtgacaacacctaagtgggattgggtatgaagtgaagttttaatctataaagtctgctaactgaggggccctggtactttcctgctttcgtattataggtgttcaaatgcaattaaggtcagaaacatgtagttgtgttctgaaataggcacctgagaaatgttactacagaagctagatccctaacttggctcttgacttgtatatgagtatttcctcagttttgtgcaatatttggcaacattggtattatacttaaagtatatatttagaaatgggacttcatcttacagaactgttttttaaaatatttttatgctaccagaaactcctagaagctcatgaagaacagaacagtgaagcttacactgaagcagtaagttatgcttttgggacatggtacattatttgaagatttaagttaaagaaacttcttttccttttcattatgtgaattctaaacatttatttgaacatgactccagcataccttaagttgtattttccaaacgtcaccttttatatatcacacaaattaaacagttccattagccatgctgagattcgacttacactcaaaactaatttagctgtgagactagttcaggagcaaatattccatttatattcttataatttgctgttttaattttttcttttgaaaataatctgacccataaataagtataaagtaaaattagttaaggccgggcacggcgtctcacacctgtaatcctggcactttcggaggccgaggcaggcagatcatgagtcaggaaattgagaccatcctcgccaacatggtgaaaccccgtctctactaaaaatataaaaattagccnggcatgctggcacacgcctgtagtcccagctactcgggaggctgaggcnggagaatcgcttgaacccgggaggcagaggttgcagtgagctgagattgcaccactgcactccagcctggtgacagagcgagactctgtcnc

SEQ ID NO: 337529 - DNA, 720 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaaggtaagacagccaggcatgtagcatgctatctctgtgtgtaactaaccagtcagtacttccctcaacgttaaggtcagtgttggtgtgctttcaagtcctggtaaaaaggaatttttgtattttggaataatagagaattttgataaccttagggatttttcttttttaatcatttgggggcttttatgaggagaaattatgttaaatttatactggctgtttactttatagcatcatttaattaaactcttatttatattgcattttagagaattttttggaaattacctttaattttatctaagacttcttatatcttaattttgtgaaaatg

SEQ ID NO: 337530 - DNA, 777 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaaacacaagaatagaaagaaggcttgttgaaaattgttattacccaagaaggctggcaaaattattgttccaagaatgggcttacaaaaatttgggaaggtggctggcaagggaacaacggccaattttttggttccaagggccaaggccaaaggcttccaacaattgccaaggctttcaaggaaggcaaaaacaatttggaagttcttggcttaccaaggctttttggttgggattggcttgggaaaattggctttacgaaaaaagggcaggaattccccaaagaaaggggctttattccaaattggctttaaattgggcaaggccaattcggaacaattttttacaacaatgaacattgggcggaaggggtttacaatttgggcacggcccccaagtgtacagcccacctttatacctcttattggcccggaagatttcccatagtgagcactgtggaaccctgggttaggaccttgggcagaaagcggccatatggcccccttttattggaccccaactctgccttggcttaatttcccaaggggaggagagaattcccagacaggttcaggcaaaccatt

SEQ ID NO: 337531 - DNA, 4369 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatgctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagtatgcttgttttattttaacctataaagtggaaattatcagtaatattttgatgagtcttgttgctaaattggcataggtcaaaagtagcttccattgtttcaagttgttcccgttaagattaaggcaacagacgttaatactctctaggctccggtcatttgttgggaattccagggcaccgtaatggttttgcagactgagggtttagaaggaaaccctggtaacttctgttgatgcagtccactaaagtacatgataaccctgcagaccccacattctcatcccttccttgaatcctttagggtctacagttacttgcaaagttgaggaaggcatggttgctggaagactggtggggaggtgaggcacccctaagcctgacactctcctaccccaagaaagtaccactcaactatctggtcagtgtgggcatttattttaattttgcaaaatatctgcacagggagaggagatgcccctggggaagggtcagtcccactgaccactggggcctgaagttctgatgaggaagaggacccatggcgggtagtgcagaccggctcatcctaccatcctatc

SEQ ID NO: 337532 - DNA, 4629 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaagtaagtaatattagaactttgaagaaaaatgcttttgttctgttaggtgacaacacctaagtgggattgggtatgaagtgaagttttaatctataaagtctgctaactgaggggccctggtactttcctgctttcgtattataggtgttcaaatgcaattaaggtcagaaacatgtagttgtgttctgaaataggcacctgagaaatgttactacagaagctagatccctaacttggctcttgacttgtatatgagtatttcctcagttttgtgcaatatttggcaacattggtattatacttaaagtatatatttagaaatgggacttcatcttacagaactgttttttaaaatatttttatgctaccagaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagtatgcttgttttattttaacctataaagtggaaattatcagtaatattttgatgagtcttgttgctaaattggcataggtcaaaagtagcttccattgtttcaagttgttcccgttaagattaaggcaacagacgttaatactctctaggctccggtcatttgttgggaattccagggcaccgtaatggttttgcagactgagggtttagaaggaaaccctggtaacttctgttgatgcagtccactaaagtacatgataaccctgcagaccccacattctcatcccttccttgaatcctttagggtctacagttacttgcaaagttgaggaaggcatggttgctggaagactggtggggaggtgaggcacccctaagcctgacactctcctaccccaagaaagtaccactcaactatctggtcagtgtgggcatttattttaattttgcaaaatatctgcacagggagaggagatgcccctggggaagggtcagtcccactgaccactggggcctgaagttctgatgaggaagaggacccatggcgggtagtgcagaccggctcatcctaccatcctatc

SEQ ID NO: 337533 - DNA, 3651 bp, Homo sapiens
agaatatcatacaaagaagttagacagaaagtagaaatacatacaatatgacttcatttatataaagtccaaaacaggagaaaccactgacaatacaaatcagagtgtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagtatgcttgttttattttaacctataaagtggaaattatcagtaatattttgatgagtcttgttgctaaattggcataggtcaaaagtagcttccattgtttcaagttgttcccgttaagattaaggcaacagacgttaatactctctaggctccggtcatttgttgggaattccagggcaccgtaatggttttgcagactgagggtttagaaggaaaccctggtaacttctgttgatgcagtccactaaagtacatgataaccctgcagaccccacattctcatcccttccttgaatcctttagggtctacagttacttgcaaagttgaggaaggcatggttgctggaagactggtggggaggtgaggcacccctaagcctgacactctcctaccccaagaaagtaccactcaactatctggtcagtgtgggcatttattttaattttgcaaaatatctgcacagggagaggagatgcccctggggaagggtcagtcccactgaccactggggcctgaagttctgatgaggaagaggacccatggcgggtagtgcagaccggctcatcctaccatcctatc

SEQ ID NO: 337534 - DNA, 3291 bp, Homo sapiens
cggttagcacactgcaacattaaacagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagtatgcttgttttattttaacctataaagtggaaattatcagtaatattttgatgagtcttgttgctaaattggcataggtcaaaagtagcttccattgtttcaagttgttcccgttaagattaaggcaacagacgttaatactctctaggctccggtcatttgttgggaattccagggcaccgtaatggttttgcagactgagggtttagaaggaaaccctggtaacttctgttgatgcagtccactaaagtacatgataaccctgcagaccccacattctcatcccttccttgaatcctttagggtctacagttacttgcaaagttgaggaaggcatggttgctggaagactggtggggaggtgaggcacccctaagcctgacactctcctaccccaagaaagtaccactcaactatctggtcagtgtgggcatttattttaattttgcaaaatatctgcacagggagaggagatgcccctggggaagggtcagtcccactgaccactggggcctgaagttctgatgaggaagaggacccatggcgggtagtgcagaccggctcatcctaccatcctatc

SEQ ID NO: 337535 - DNA, 3896 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtacatatacacgttgtcgtttgtgggcccttcggtgggggtgcggtctgctgcccgtgcgtggggtggcttgtgcggggtggca

SEQ ID NO: 337536 - DNA, 3538 bp, Homo sapiens
  misc_feature (3509)..(3509): n is a, c, g, or t
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagccagtntggagagacgggggatcctctaggcagcc

SEQ ID NO: 337537 - DNA, 2006 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttgaatagggagctttgtcaagggatgacctgagtcccttcctcaattataaaaagacaccaccgggccgggcatggtggctcatgcctgtaatcccagcactttgggaggcggaggtgtcagaagtgagaagcg

SEQ ID NO: 337538 - DNA, 813 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctccttgagacaatattgaggaaaatggtttcccaggcattttactggattccagagaatgctacttattgaaaaaaactcctagaagctcctgacgaa

SEQ ID NO: 337539 - DNA, 4422 bp, Homo sapiens
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaatttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttcttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgattctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagtatgcttgttttattttaacctataaagtggaaattatcagtaatattttgatgagtcttgttgctaaattggcataggtcaaaagtagcttccattgtttcaagttgttcccgttaagattaaggcaacagacgttaatactctctaggctccggtcatttgttgggaattccagggcaccgtaatggttttgcagactgagggtttagaaggaaaccctggtaacttctgttgatgcagtccactaaagtacatgataaccctgcagaccccacattctcatcccttccttgaatcctttagggtctacagttacttgcaaagttgaggaaggcatggttgctggaagactggtggggaggtgaggcacccctaagcctgacactctcctaccccaagaaagtaccactcaactatctggtcagtgtgggcatttattttaattttgcaaaatatctgcacagggagaggagatgcccctggggaagggtcagtcccactgaccactggggcctgaagttctgatgaggaagaggacccatggcgggtagtgcagaccggctcatcctaccatcctatc

SEQ ID NO: 337540 - DNA, 1484 bp, Homo sapiens
  misc_feature (1343)..(1343): n is a, c, g, or t
  misc_feature (1392)..(1392): n is a, c, g, or t
  misc_feature (1483)..(1483): n is a, c, g, or t
agcgggtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtaagttatgcttttgggacatggtacattatttgaagatttaagttaaagaaacttcttttccttttcattatgtgaattctaaacatttatttgaacatgactccagcataccttaagttgtattttccaaacgtcaccttttatatatcacacaaattaaacagttccattagccatgctgagattcgacttacactcaaaactaatttagctgtgagactagttcaggagcaaatattccatttatattcttataatttgctgttttaattttttcttttgaaaataatctgacccataaataagtataaagtaaaattagttaaggccgggcacggcgtctcacacctgtaatcctggcactttcggaggccgaggcaggcagatcatgagtcaggaaattgagaccatcctcgccaacatggtgaaaccccgtctctactaaaaatataaaaattagccnggcatgctggcacacgcctgtagtcccagctactcgggaggctgaggcnggagaatcgcttgaacccgggaggcagaggttgcagtgagctgagattgcaccactgcactccagcctggtgacagagcgagactctgtcnc

SEQ ID NO: 337541 - DNA, 537 bp, Homo sapiens
aatttattatgtaaatctggaatcctacactaataaggtcatttgctgtttccagtagaataaaaacttgaagccatgctttttgaccttgatgtctgcagtaactgttcttttcaagcttgctgagaagacagaaagcaatgttgactttcaagggggaaaataaatatttgaagatagggtttagttgtctcagtttgcactgtcagcataagcaaagaccttcccttattcgctttgaaaaaaaaaccttatttttagagtaagggaaggaaacatgtctgttgagaaaaccttgctaaattttgtggaagtgcaaaattctctccttagtcctctccttttctgtagctaacaatagtaacagtgattacagtcagcatttgaatgtgtatgagccagaccctgaactgtttacccttaaaatacctccattagttgttactctcattgctacaaatgatgagactgaggtttagagaggttatttatcacttaaagccataataaatttagggttgatggggtaccgagctc

SEQ ID NO: 337542 - DNA, 936 bp, Homo sapiens
agcggggtactgaaaaaagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacgtgagttgaccatacaactttaacggtttctccttaaatcaagtagtctgggcctgtcagacaaataaatta

SEQ ID NO: 337543 - DNA, 478 bp, Homo sapiens
ccgagatgcagcaacgacgtcacgggccatgtggacgtcacacatattaatgtcacacagacgcggcgatggcatcacacagacggtgatgatgtcacacacagacacagtgaccacacacaccatgacgacgacacctatagattatggcacctacatcacaagcacgcatgcccgttcacacacactttctacccaattctcacctagtgtcacgttcccccgggaagttcctggtacttcccgggggagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacgtgagttgaccatacaactttaacggtttctccttaaatcaagtagtctgggcctgtcagacaaataaatta

SEQ ID NO: 337544 - DNA, 1006 bp, Homo sapiens
atgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatgatctgggaagaaaagtgtggtcaggacactcttgggacgctcttttgatagctctctataagggagctgctttccatgtcttttaagattttccttcttttacacca

SEQ ID NO: 337545 - DNA, 498 bp, Homo sapiens
cttcttgtacaaccaaaagactggcagctcgtgtttatcttttccctatgaggctcaggggttagcagctctatagataaggacaattgtgccataaactcaactgcatttgcacaaaactagtagagatagcctatcccttcctatcttaaatctttgtacttgcttctcttctttactaatgtatgtctttcatgccatttattttctagagtagggcacttttgtctgcattaaaaatctgttcaggcagttatcctttcttctcaatgattttcttaatggcatctgggaactggtttgctgtttcttggtcagcagaagctgcttctcctattatcttgacatttttaagtaaaacctctttctcaaattatcaaaccatcctttgctggtattaaattcgcctttaatctatcacataatggagacttgacttttcctcaaatcgcattagagtctataggtaagcctttcctttcttagcaatccagcact

SEQ ID NO: 337546 - DNA, 602 bp, Homo sapiens
ccgggttcaagcgattgtcctgcctcagcctcccaaatagatgggatcacaaatgtctaccaccatgcctggctaattgttatatttttagtagagacggggttttgccatgttggccaggctggtctcttaattcctgacttcaagtgacccacccacctcagcctcccaaggtgctgggattacaagcgtgagctactgcgcccggcctctccaggatttcaagttaggcgccctgcattttgggcagagattgagattgtgaatctgtctcctggccatgcagtatgtttgtttgtttcacgtgaatttattgccaagtttaaaaagaaaaatcatagagggacatagcaactggcgtttgctctcgctcagttccccactcatgagttcaagccttggctctggcatggtttttatgttttctgtggtatgagctggccacaccctggtctggggatgctgttggccatgccgatgaccgagtgtctcatgcagccggccctgtctatgttactctttgcctatgtccagcatttggtcaccgttctgtactaaagttgaatattgcctgtgggcctcaggaagtcactgtatatggc

SEQ ID NO: 337547 - DNA, 774 bp, Homo sapiens
gaaggtggctgtgatgtgccttacagagaaaaagtcttagataagctttgttcaggcatgagttatagtgctgttggctgtgaattgctgcataaggtatcttcaaacagaaacccacataaaacaaggttatgtattgatcagtaacaaaaatgtggccagaggctcccgggaacctaattctatattttttccctaggctggatgcttcgctgttcactaattcagtgtttacagcaactttatagaatgtgactaccacacataatgagaatcgactatactattgttatctttttggctttctttttaacagatgaggaaacaggttgggagagattaaataacttgttccgagtcagtgtttctagtgaatagcagagtcaggatggaatccaggtcctgtctcattgcaaaggcttgaccatacgaaattcttcctcctcccacatactcgagttcgtgtatacggggggttagaaactcagttaccttggctccccaggcaaataaagcacatgggtgaaacagtaccagacatagaccacagactgttgaacggagaatgcacatcgtctaaaagggcagcagagaatcggctccagcaaaggccgccagctggaggcgggcccgggactgcctgggcagccttttgttttttatattttaagagaacctgaatgtttgggtattgatgtaaacttcaaattttttaatgctggccactaaattttttttttttttttgagatgggatcttgctcagccactgagg

SEQ ID NO: 337548 - DNA, 553 bp, Homo sapiens
taccccacagcttcaagtgcaccctccgtagggcctcaccccctttgccttttctaaccactgcctcccctcatccacacaatctccctcctcctccaccctccagagcctcccctcctcttgctccacttcctctcctaagtggaattgcacaactcagcgagtgcagaggatctgactccacacagactcactttgcagcctaggggcaaacagaaggacactgtttctggaagcttctttcccagccaccagcatggggctgccagggccaaactgccctcatcccttacctgactcccaggtcaggaggcactgccaagggctcctcagccggctctcctgctttcccaggccaggctttctgtggtttgaatttcccaactgatgctcagaaacccgcctcccgctgggccacatatctcttttcacacaagcttcaactccacatggcagaaagacaaaagccactgctgctttaacagccctggtagcacgcttctatcattaaaaggcgagggagtgagggcccagaggggccgtcttccccggt

SEQ ID NO: 337549 - DNA, 353 bp, Homo sapiens
ttaaaactgcatgttaattttctattgctgctgaaataaattcaaaaatttagttgcttaaaaataacttttttttttttacagttctatattttagaaggccaacatgggtctcactgaactaaaaccaaggtgtcaagagggcagtattcctttctacaggctgtaagaaagaatctgtttctattttctatgacttttctagcttctagtgggtgcccacatttcacaatttgtagccctttcctccaacttcaaagccatcaacattgtatctctctgaccactcttttgtagtctcatctttctctgactctcttttattgcctctcctttaactttttttttttttt

SEQ ID NO: 337550 - DNA, 599 bp, Homo sapiens
caaaagctgattggaagtctattcttccacccttgccagcctgccaggatggtgtcagaaaggccatgtagaaagcagagtttcatccccactgagtggtgagaagattttctcaatggatatcatatgaagagtcagaacttcaccatgtcacccctcaatttggcagtaaagaagtacctgtcccctctcagcagggtagtgtcagaagaagcctactggagagtcaggactttcaccaccactcaattgccacaggccacccccatggtgtcaatagaggatgagtggggagctggaaaccccgcttccacccggcaataatgaggttccctcccctccccgacttgagtgtcaacagatgctgagggggaactgaaagaaaaaaatagattaacccacaattatagttagaaacttctctactcttttctcaacaactgatagagcaactagacagaaaatcagcaaagatataaaagaactcaatgaaagcatcaatcaaaaggatttaattgactttaatagaacatgctacctaataacagcaagatgtacattatttttatacatatccaagatagactatatgctgggcc

SEQ ID NO: 337551 - DNA, 811 bp, Homo sapiens
gtttaagcaaaaggggtcatgttactgtatctgtgctatggaacataattagctgacgcttagaaggtgaccctgagaggtgaggtccaagatagagagtcagccagggaattagtgaagtcgtctaggcaaaagctgagagggaaagcagagacatggagaggggttggagctgttgcccatagcaagcagttaaaaattggctgagccagacctgaacccactgggtcctttgatttcatgcctttttcttgttagcatttaccaatttttcttccagagcttaagttgtaactaggtgttcagtgggacaaaaggttctgggatcaaataagtgtgggcatgccaggttaaacagagttagagagattccttcatttgagaattcttaggagttaggtacggatttatgtatcatgactctgagatattgtttcccagtcatttgactacagaacccattggtccctgtcagtagtagtacaccttgtggaaagcggcaaaagtttggtaaatgtttctctgtatcagcatgcctaactttgaatcctaatgagaactctgtgaggcagaaataacagtttcaggctgggcacggtggctcacacctgtaaacccagcactttgggaggctgaggtgggtggatcatttgaggtcaggagttcgagaccagcctggccaacgtggtgaaaccccatctctactaaaataaaaaagaaaagaaaagaaaacagtttcaccaatgagaaaactgagactcaggtgaagtaactttccgaggtcccacattaagtagtcaagtagaggaag

SEQ ID NO: 337552 - DNA, 162 bp, Homo sapiens
gcatgagccactgcacccggcccagatatggaattttgccactgtggctgcctgcacaggttttgggaacagacttcatggggctattcttaactgtgaaaagaaccattcctggtgataattcgtaattttatgtataagatcatagatgtatctagttgt

SEQ ID NO: 337553 - DNA, 494 bp, Homo sapiens
attaaacctacatttaaataaccaaatcatattttcttgaatccaaaattattctgaaaaacaaaacaaagaaatttaaagtctcaaggctcctaacgtcacaacaatgcttctgtaaaaattttcagctatttaggggggaaatactagttctagtaagttttccaaaataaagatgtaatgaaaaatagtatctcagagtccatcccagtcttaagattttaatactctacataaaccattcttgtaggcattttgaaaatatgacctactatgttaaaacagggatattctcaaggatctaaaactatcaggcaggttagggattccaaactaaacttgggcaatgagcctaagcaaatttcaatataaactatgcttcccagcttagcttagttttcataaatttctgaatatgtcagctttgagcagatatcagagtatttttaatctatcaaagataaaatacacagagtatagtaacaattacattt

SEQ ID NO: 337554 - DNA, 469 bp, Homo sapiens
tcacacattatggaatctaacttgctatatgtcattggtgcacaatagctagaatttagtattaaaactagtccatgaaaaaagcaatttaccaataatatgaggaaaaagtaaactgagaggagattttatgatttaggagaggttatatgtatagttgtaaatcataagttataacaggaaagatagctataacataaatgagcaaataagcaagacttgagtatatgagaaaagtaactggacatattgcctatcttgcaaaatgtgtgaaccagaattcttggtataatattttaatgagtactctggattctaaagtattctaaccaaattgttattttatagaatatcaaggtatatctttggttaactttgtgttagaattctatgtggatgtcacccattttctggcacctttaatgaaatcttctagactttctttctgtaaaatctcattactctgact

SEQ ID NO: 337555 - DNA, 463 bp, Homo sapiens
ttaattcattgaaagcttgtaggacagtgcctggtagataacggcactcagtaaacattagcaatcattacctggtccctcatttaacatttaacccctttaataccctaagaggcagacgcttttgtcccttccattttgctgagatccaccaagtcgtgggaagggtgcgtgactcacccacactgctggtcagtgagtgcagacgcggggatctataggagaactgggtggtggatctctaggggaatagtgtggtggttctgatccaaagcctgtctgcctggatccacatcccggctctgcttctcctgcactgctcactctggaaagctgcttaaattctctgtgacccaatttccccttcctaaaatggagacaatagtacgtagtcgcagtctcgtatatttgatgtggggtttaaatgacctcatgtatgtaaaatgcttagagccaagcctga

SEQ ID NO: 337556 - DNA, 314 bp, Homo sapiens
tgcggagagtatctaggtgtgaggagagaggcagcctctcatccccaaggagactgagggctttggctgctgggacacgaggcctgtgttctttgtttttgtttttgtttgagacaggtctcactctgtttcccaggctggagtacagtggtgcaatcatagctcactgcagcctccacctcccgggctccagtgatcctcccctctcagtctcctgagtaactgggactatgctcagctctgtgtaaaaattagctgccaccactcctggctaatttttaactttttgtagaaacggtgtctccatatgctgc

SEQ ID NO: 337557 - DNA, 221 bp, Homo sapiens
aaataaagtgtctgaaagaatgaaaaaaatggaagaattctttagtaaggtataaaataccctttctatctttgtagcattctaagccttttgtcacctttccaaactcccaacatgccatattccctgactaggccacagccatgtacattgatccctttattttcttctctctgcctgagatttctctcattcccccttctctgcctggtatatgattg

SEQ ID NO: 337558 - DNA, 358 bp, Homo sapiens
ctgctgctgttattcattccactgtatctaatctctgtactcttaaattttacaactttactcaataacttttaaaatattctacacttgtggctcccataaatttcctctttgctctattgaggccatttctagtccctgtgtgatcagggttattggagagcaactgataaaccagccatgctccccacttcctctctaggagctcggcctcctcagcttgtctgcagacctttgcctcttaatttatccagtccagctctcatgtcttccctgatgaagtggagtcgagaaatctgctccgtcaccttctgtgtgaggagcagcctctgcagcttgtcccactgctgtagctctc

SEQ ID NO: 337559 - DNA, 330 bp, Homo sapiens
gtataggtttgttgcgtaggagctgtaggctataccatatagcctagatttaggctgtattatctaggtttgttaagggacactctgtgatgtttgcacaatgatgaaatggaatgaaggcacatttctcgtaatgtatccctgtcattaagctaggcatgactgaaccgatatgtgctacaatgttgatgtatttgaaaacactatgctaagtaaaagaagccagtcacaaagaactagatattgtgtgatgccatttatattaaatgtcctgaataggtaaatccataaagacgcaaatacgtaagtggttgtcaagggcaggggtga

SEQ ID NO: 337560 - DNA, 491 bp, Homo sapiens
ggtctggaaagcaagactctgaaattacttcactctaacttttcaaagcccctttctcacatattcatgtcttagtttgctattctttaaaatgaggaggaaaatcttaaggaagtcaacaatggtaatagagggatactagtgactttaaggcctacgctgaaatcacaatagaaagacaataaaatggttttaaattgtggcagaggaagtttcgtatccaaagggatttctaattgttgaactaatggaaccatcctccagagatcactgaaaatgggagaggccttcaacctgtctttactaggttaagagacaccctatttggagtccagagtaaagggcaagaggatcccttgaagtcctgccagatttttgtgattttttcctgaaatctgtccaattgttttagtacaataaattggggtattcttccagaccttaagaacaccttccaggcctggcgtggtggcttgcacccataatcctgg

SEQ ID NO: 337561 - DNA, 106 bp, Homo sapiens
gtatgaaaaatggaatcatgttctggaattttttttcccctcaatctcagaccaacaggcattttaaaaagtttaagccaataaaacgtttagagaccatagatta

SEQ ID NO: 337562 - DNA, 372 bp, Homo sapiens
tggaaaaagtaaataggcttcatatttgaatagctaaatcatacattttggacttttcaaaaactaagtgtaaaaaggtatatataacacaagtttcaaattgcttggaagaaataatcaaccaaaggagacaggagttatgataaacaaaatgaacagtatttttaaaactagacagtcttatttgataggaaaagtaaaagattgtaatgcaagccccacatttatcacaggtttacgctcagacacctgaaactttgtgcagatctctatgagggagaaaacaaagtagatgaatagagaacacagatggagggctttttgttttgttttgtttcttttgaggctgagtctcgctgtcacccaggctgg

SEQ ID NO: 337563 - DNA, 528 bp, Homo sapiens
ctccattactccatcatgcaagcaaacacaatttctaagaaaaaagaaaaggaaagtggacatatagtagtgtctaagcgccccctgccttgtacccctggagatacaagctcccaaatgtttttattagtgagtcaattatttaacagggatattgaaattatttgtggaaaagtgttctcagatgtgataacaaaagacaagtattttattttctatatgtttgtgattaatgaacatcttttaacagctgaacctggaaggcaactgaaatccaggccatagtgtgtacagggcacctatggctctgctgaagggaatgtgagttaactcacgacccagagtaattcaatttatgaaggattcccttggttttaatactattttactaaactcaaatattggctaatgaggttatttgaagaaaaaaatagtgtttcagaaatggaaatacttaatacaagatgattccttatgtgtagtttgtcatctagtgttaatttgtgggaattaaaaaaggcaggtaca

SEQ ID NO: 337564 - DNA, 878 bp, Homo sapiens
tgtgtggtctctagagtagacacgaactatggcatattgttttgctatagagattctgagtacccagtcttttggaagtactgttttaacaagggtttggcaacgtagaaacatgaggagcactctggctccctagcaagaggaaggagcatctcagtggtgctgaattctcatcttcggagggtttgtcctgcagccctctgcggcagaagctgagagcactggctcttgccctggcttgggttggccacccttgctggagggtgttctgcagggaccctgcttttttcctaccagttcaactagttgtactatacaaaactgtacagtggtgactaaccagggaccggatacagcttgtttagatttgagataaaacctactgtttaatttcacgaacttccctggtgaaagccaaacttagctgtgtcccttgtcctggtcactgcttggctggtggtggggcaggggtgaataaggctactgcaaggactgggagcgtagcctgcgggaggcagtgaggagcctagcctagcattgaggagactgaggaggggggcattttaaaaataaaactatggcttctgccaagaagagaaaagcagctgatgaaaatcatgtgtttcaaagtaagtagactgagcgatgcttattatttgtgctgaagatactgtcatttgtctgattagcaatagaaaacaatcttattttaaagagcacagtagcttgtaagttcagtcaggaaaagacaaatacacagcctcagaagactcctctgcagggtaaagcaaatttggtttagtgcgtggcattatcatgagtccctgaaggctgtgctcattaaagagtgttgacatttttttagccccccaaaaagg

SEQ ID NO: 337565 - DNA, 532 bp, Homo sapiens
gatgtatatcccgaggtggttttaaacctggcatgtgtaattaaatccctgagttcctaatggagtccctcatgtcttttatttctgagctctctttatagggctattttgacacttttctgttttttttttttctctttttttttcctcgctcttgtcccccaggctggagtgcagtggcacaatcttggctcactgcaaccgccacctcctgggttcaagtgattctcctgcctcagcctcccaattagtgggattacaagcgtgagccaccgttccccaccaatagttacttttttttatgaggagcaaataatctagaatccttcttagttcctaggtaagcaattaactgttcagagtcttccagccccaccccctaattttccttatttgtcttctgccactaagtttcagcatttggtttggttttgggccctttgtactcttctttctggcttttgctaattgccctggtatttttctagtgtccattgttagcactcctcaaattttaacttagtccattttt

SEQ ID NO: 337566 - DNA, 669 bp, Homo sapiens
tgtgtgtgtgtgtgtgtgtgtgtgtgtgtatgtatgtgtatgtgtatgtgtgtctgcctgcctgtgtggaggggacccttttagaactctccttacagtggcagatagcagtagttatttttttcttttctttttttttgagacagagtcttcctgtgtcacccaggctggagtgcagtggcacaatcttggctcactgcaaccgccacctcctgggttcaagtgattctcctgcctcagcctcccaattagctggaattacaggcacccaccactacgcctggctaatttttgtatttttagtagagctggggtttcaccataatggccaggctggtctcaaactcctgacctcaggtgatccacccaccttggcctcccaaagtgctgggattacaagcgtgagccaccgttccccaccaatagttacttttttttatgaggagcaaataatctagaatccttcttagttcctaggtaagcaattaactgttcagagtcttccagccccaccccctaattttccttatttgtcttctgccactaagtttcagcatttggtttggttttgggccctttgtactcttctttctggcttttgctaattgccctggtatttttctagtgtccattgttagcactcctcaaattttaacttagtccattttt

SEQ ID NO: 337567 - DNA, 438 bp, Homo sapiens
cattcagatatcttaaaggataacttgttcttattttgagtagatgacatataaaaaacatattttgaaactgatagagaattctattctctaaggtttctttttcttagttttttactcctcgagtaatcagatggacacagattcttcagaagacacatttagaggaaagacagataatcaaggaaaactgtgtgacattttgagaataaatactaaaagaggaatttggtgctaaaaagaagttatcaagacaaaaatattagttctctcaaaacttataagaccaactattgaacctagaaataacctgaacataagaaatgaactattctgtcaggaatagataaagaaaagggacacaagagacagctaactatgaagttttaaaaaagaaaaaagggccaggtgcagtggctcatgcctgtaatcctagca

SEQ ID NO: 337568 - DNA, 393 bp, Homo sapiens
tctcatttttgtgtagttactgaacttggtggctgtgattagtatgctgtaaataagcagagataattgtctaaccatcagacacctaagcattagatttattgcttttatgtgaagaatattgtaactgatttgaatataaactatgaattttctgtactccatagttcttttatggtaaatgcacatatacatttttacatttccattgatatttaggatagtataataacttcacaaattatttttgaatgaatacagaaaaggaaactggcagattttcattcacattcatttagcaattatttattaaatgcctactgtggcaggccctgtaaagtactgtgaaatattttgacttttaagattgatcttgtgttaaggctgagatac

SEQ ID NO: 337569 - DNA, 125 bp, Homo sapiens
caggcaggctttcaaatctcatgtgcctctaattttctcagtgtgattcagtagctctgctcctgtttggcctctctgggttatctcaggcctctcaggaagctctcagaactctcgtcactaca

SEQ ID NO: 337570 - DNA, 934 bp, Homo sapiens
aaaaaagtaaaatatttcattaataatttttatatttcattcatattgaagtaatattttagatatattaatttcacgtttctaaaactagaaaatctaaacttacaatgtgattcacattagatttctattggatggtgctgtcctacagcaaagcaaccagctttcaaatcctacccacgcacctagagtttccaatctgctttgtaatccctcattcttaaacatgagtagacaacccaggattatcagacatctgaggaaagatcctaacatgagagaaagcggggctgggggaagcaacttgccaaataaacagtatgcaacaagaagaaagatgttctaaaaatcattaatatccacaacaaacattcagaggaaaaagaggtcattagaagtttaaaatacaagaacagaaatgaaaactcaataaaaggactggaagaattaaggaaattccccaaaaagtacagcaaaaagataagaaaattagaagaccagtttgggaggaccaatatccaaataataggagaaaacataaaatagagagcaagttatcaaggaaataaagaaaatttcccagtattgaaggataagtctctagcacaaaggacaaaaatagattattcaaaggcatataatggtgaaatttcaaaacaccggaatacaaagaaaatcctacaaaattccacagaaaggatgaaaacaggtcatatacaaaggaatcagagcagttctgggtttcttaacaataatatcaacagctgggtggcaatggaacaaggcctttaaaaatctgaagaaaaataatttccaaactacaaatctatacccaacaaaaactatcaatcaaatgtcagcttagaatagacattttcagacatttaagctttaaaaaatctgttcccatataccgcaggaagctactgtagga

SEQ ID NO: 337571 - DNA, 376 bp, Homo sapiens
atcgcgccattgcattccagcctaggtaacagagcgagattccatctctaaataaataaatagaacattgtggatgtggcaggaaacctccttccttcagaaagtaagccagagcctcaagccccagtgtgcaccgagggccttccaggacctgtctcctgggatctcggctcacagtccccgtcctgatctcttccttcctggaagaacaaggaataatttcaaatcctcttgcagctagcttgtccgtacgactcacaaaccgcatcctttaacccaatttttttttttggacaagtaaaactagaattagctttatttaacatgattgtgaaaggaacacttattttaatttttttaaaagaatttagatttc

SEQ ID NO: 337572 - DNA, 510 bp, Homo sapiens
aatcatgccaaacactattctacttattgatttaaatatgaagaatgctggctatgtatgctccagcaattcctctcccaaatctaccctagaaagacatttacacgtggcctaggagaatcacacaaagatgtttgtcacattgctgtatgcaacagcaagtaatgaatagccgtgcaactgtcagatgaactatggtacattcataatatacagcatttgaaaaggatgcagcctgggtgacagagtgagactctgtctccaaaaaaaaaaaaaaaaaaatttaactttggaaataattacaaactcaaaaaacctgtgcaaaagtggtccagagatctgtggggtcctcttatatacaactacccggaacggtggatatctaacccatagaccttggtagaaaccaataaatggacattggagacaaggttataaatccaagacagatttaactgggacttacatcagatacacaatgcactctcgggtgatagtactacccaatgg

SEQ ID NO: 337573 - DNA, 450 bp, Homo sapiens
aatcatgccaaacactattctacttattgatttaaatatgaagaatgctggctatgtatgctccagcaattcctctcccaaatctaccctagaaagacatttacacgtggcctaggagaatcacacaaagatgtttgtcacattgctgtatgcaacagcaagtaatgaatagccgtgcaactgtcagatgaactatggtacattcataatatacagcatttgaaaaggatgcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggag

SEQ ID NO: 337574 - DNA, 4677 bp, Homo sapiens
caggcacgtcccgggggctccagcttctgctcagagcgcggagagccgggccgggcgggcgcgcgcgcaggactcgggccgctcgaggggtccggccggacggtgtcgggagccggacccgtcggcagaggagcgggcgccgcgatggctgagggcagtgccgtgtctgaccctcagcacgccgcgcgtctgctgcgagcgctcagctctttccgcgaggagtctcgcttctgcgacgcgcacctggtcctcgacggggaggagatcccggtgcagaagaacatcctggcggcggccagcccgtacatcaggacaaagttaaactataatcctccaaaagatgatggatcaacttataagattgaacttgaagggatatcggtaatggttatgagagagatcctggattacatcttcagtgggcagatcaggctaaatgaagatacaatccaagatgttgttcaggcagctgacctgctgctactgacggaccttaaaaccctgtgctgtgagtttttggaaggctgcattgctgctgagaactgtattggtatccgtgactttgcactacattactgcctccatcacgttcattaccttgccacagaatacctggagactcatttccgagacgtcagcagcacggaagaattcttagagctgagtcctcaaaagcttaaagaagtgatttctcttgagaagttaaacgttggcaatgaaagatatgtctttgaagcagtaattcgatggatagcacatgatacagaaataagaaaggtccacatgaaggatgttatgtcagctctgtgggtttcagggttggactccagttatttacgggaacagatgctgaatgaaccattagtacgagaaattgtcaaagagtgtagcaatataccgctcagccagccgcagcaaggggaggcgatgctggccaacttcaaaccccggggctactctgagtgcatcgtgactgttggtggagaagagagagtttcacggaaacccacagcagcgatgcgatgcatgtgccctctctatgaccctaacaggcagctttggatcgaactggcccctttaagcatgccgagaattaaccatggagttctctcagcagaaggatttttgtttgtattcgggggccaagatgaaaataagcagactcttagctcaggagaaaagtatgatccagatgcaaatacatggacagcattgccacctatgaacgaggcaagacataacttcggaattgtggagatagatgggatgctgtacattttgggaggagaggatggtgaaaaggagctgatttccatggagtgttacgatatttattctaaaacctggacaaagcaacctgatttgaccatggtcagaaagatcggctgctatgcagctatgaaaaagaaaatctacgccatgggtggaggctcctatggaaagctttttgagtctgtagagtgttatgatcccaggacccagcagtggactgccatatgtccactaaaagagaggaggtttggagcggtggcctgtggagttgctatggagctgtatgtgtttgggggagtccgaagtcgtgaggacgcccagggtagcgagatggtaacttgcaagtccgagttctaccatgatgagtttaaaaggtggatctatcttaacgaccagaatttatgcatccccgccagttcctcttttgtttatggagctgtacctataggagccagtatttatgttattggagatcttgatacaggtaccaattacgactacgtgcgtgagtttaaaagaagcacaggaacctggcaccacactaaaccactccttccatccgaccttcgccgtacaggatgtgcagccttacgcattgcgaattgcaagcttttccgcctgcagcttcagcaaggcttattccgtattcgtgttcattccccttgaggaggaagcagagcagagtgcgagatcctgacccaagagcaccataacatagctccgaaagggagagcagagatggcagctgaaactcactctgtgctgggctttggtatggtaactctttggtggttttatgatgcttacaaacttgagctttagctcttgtttgggagaacacgtaactgttgaaaaactacctgggaggagtgagttcctccagttaaatgtggctgtagatgttggaggctagggaggctagtaaatatcaaaaggaaaagggagtgggaattgctatcatgtaaaatatcaaagttaaaatactaaggtgcattttccctgaagggaactcatgtctgactgctgtattcaaatacgtagctttggtaacaaacaaaatccgtatatgcaaatcaacatatccaaacatgccaagactgcttttccactgcacttggaaggatatattatgcctaaccctgcccaacaaattaaggtttgtgcctaaaatgttagattggactgtatgccagttagtctccatttattcctagtactctgtcctaagaatctttttaaaactatatcatgatgaattgaaatgaagataaaattgctcttttgtaactttatcttagtaatgtaaagattcagtaaattgatgagtcaggttgcagccctcatgtgaactgaaagaagttgctcgcttctgtgttgacttagatcaagacacgtcacgcatcctttctggggtagtacctgtggagccgggaagggtctcctgcagtgccattctgccttctcaatgagcaaaaccattttctaagtatgaggatattagtgagtaggagattttataaaagaaagacctgagtcagacaaataataaaggtctgctgtggctaaaaaagcaaaaacaaaaaagctatccagacaaaatacatagggatcagaaactttttcatataacctgtctgaaagcacacaaagtcttgtttactactgtttagggtttgaaaacttgtcttagaatgcgaatctgtgttaagaatctagtctttgtaatagaagtttcccagtggcattcactagtgagagttttagacaaattatgttacgagtaaagtttggctggtagaataaactacctcaacttaatttcattctgttcatagtagagcaaattaatcttttcctccttccctcctttcctatctctcattctcacctcaacccactttaccccacttctcattgggggaaaaatgtctttcgttcgtggaacgtatcttgtaagatattttgttttccacttgaattacaccaccctagtgtgaaatcggggacttcaaagtgcttgattccttcctaaattgaattttatgcaatgtcaaatttctaatcaatttaatatacagtacttcatttttaattgttttctaaaaaaaaggttttttttttccttttggaatatggctgtaagaagcagcattttgtcttattaacacatgtataaaggtatcctttggttttaagtcgagaacaggaatttcttctagaaacttcctgtatggaacgtttatatgcaattaacatgcatatgaaaaacatcacttacgttctcccacccatagacataaaaaagggtgacctgtgattttttttcttatacctgctggaagtcagtacaatgcgtcaaaagttgctgaaagatgctgtgcctatggggttctagagagtgttgagtgtggtacattaactctccattttagccagaagatacctgataagagaaggtgtaaggtttttatcttatatgccagaggcaccaggccagatgtgccgcacagtcatgtaattcaatcatgtttaatatgtcagtcaaaaccaaattcagaattgttttgtgtaccagtcagctgttgtctgcacattttcgtagtgacagtgtggagatctttttaatgaaagcaaactatgtggcctctgcaaagaaaggaagatttttctttttacaactagatattagttttagaggaaggaaatagctgaaaaactaaatttgctttggtgaaatgtcctgtacagaacagttccttggcattcagcagctgtaattggggaacattaaaacagtaactgacatccagttaaagccacgatcgtcagcaattctccttttttaatttctgatatttaaagttttttttccagtctacaccaggcctctccaaggagacagttcattatttaggagtgaatgtgttcctcttgcaatattatcagtacctgcatgacttggtaaattcattttataaaaatagtgttttttttttttaatttcagttcattgactctataactgcagaaattagataatgttttataaaataaatttgccacataatatgggatgcaataaccaacaaagctgctaagtgccaaactgttattttactatatataaatattaaaatattgtgttgaagtatagggatgtatttaattttactatgctccaacattaatcatgactcttttgtaaattacagttatttcagtattgtaaaataaatgttgactcatttcatgcaggtttgtgttttaacattccacttatgccttgaaacatcatttcttgataactttttgatacttctttcttgataaggcacttttaccaggtgtgtgttggaattggtggctcaggataggtcttaaattttaaatacaaatatctttggg

SEQ ID NO: 337575 - DNA, 467 bp, Homo sapiens
ttttaaataaagttagccgggcacagtgctgtgcacctgtagtcccagctacccaggaggctgaggcggaaggatctgttgagcccaggagtttgaagctgcagtgaactatgatggcaccactgcactccagccaaggcaactgaacgagaccctgtctctaataaataaataaataaaaatgaggcttttgaacttctttcagttagtgaaatagtatcagttggagtaagagctccttttctgaagattaagaatatgtgtcttactttgctcttctcattttaaagtccggtgttgtaatactgaaaagcaccatcgttttacggttagaaatcaaaccccttcctaaatctctttaagtatggcccagacagtttaatatctgttcacctgacctgaatgagaaatgttgcctctcccccaccattgttctctgctttcagatcggctgctatgcagctatg

SEQ ID NO: 337576 - DNA, 1815 bp, Homo sapiens
caggcacgtcccgggggctccagcttctgctcagagcgcggagagccgggccgggcgggcgcgcgcgcaggactcgggccgctcgaggggtccggccggacggtgtcgggagccggacccgtcggcagaggagcgggcgccgcgatggctgagggcagtgccgtgtctgaccctcagcacgccgcgcgtctgctgcgagcgctcagctctttccgcgaggagtctcgcttctgcgacgcgcacctggtcctcgacggggaggagatcccggtgcagaagaacatcctggcggcggccagcccgtacatcaggacaaagttaaactataatcctccaaaagatgatggatcaacttataagattgaacttgaagggatatcggtaatggttatgagagagatcctggattacatcttcagtgggcagatcaggctaaatgaagatacaatccaagatgttgttcaggcagctgacctgctgctactgacggaccttaaaaccctgtgctgtgagtttttggaaggctgcattgctgctgagaactgtattggtatccgtgactttgcactacattactgcctccatcacgttcattaccttgccacagaatacctggagactcatttccgagacgtcagcagcacggaagaattcttagagctgagtcctcaaaagcttaaagaagtgatttctcttgagaagttaaacgttggcaatgaaagatatgtctttgaagcagtaattcgatggatagcacatgatacagaaataagaaaggtccacatgaaggatgttatgtcagctctgtgggtttcagggttggactccagttatttacgggaacagatgctgaatgaaccattagtacgagaaattgtcaaagagtgtagcaatataccgctcagccagccgcagcaaggggaggcgatgctggccaacttcaaaccccggggctactctgagtgcatcgtgactgttggtggagaagagagagtttcacggaaacccacagcagcgatgcgatgcatgtgccctctctatgaccctaacaggcagctttggatcgaactggcccctttaagcatgccgagaattaaccatggagttctctcagcagaaggatttttgtttgtattcgggggccaagatgaaaataagcagactcttagctcaggagaaaagtatgatccagatgcaaatacatggacagcattgccacctatgaacgaggcaagacataacttcggaattgtggagatagatgggatgctgtacattttgggaggagaggatggtgaaaaggagctgatttccatggagtgttacgatatttattctaaaacctggacaaagcaacctgatttgaccatggtcagaaagatcggctgctatgcagctatgaaaaagaaaatctacgccatgggtggaggctcctatggaaagctttttgagtctgtagagtgttatgatcccaggacccagcagtggactgccatatgtccactaaaagagaggaggtttggagcggtggcctgtggagttgctatggagctgtatgtgtttgggggagtccgaagtcgtgaggacgcccagggtagcgagatggtaacttgcaagtccgagttctaccatgatgagtttaaaagaatctacctgcttttcttcagtttccagagtgctcaggtagttgtagtttgtccagagtttacggctgacacttggagcaactgaggagccatttgttaagagttacttctgccatactggaagcagacgcctcactacagctctctttttctttcctcctctcctttc

SEQ ID NO: 337577 - DNA, 261 bp, Homo sapiens
tgtcttgactgagttctcctcccagggtgcaatagaagcagggcctgagctccgagggtgcccagggacagtgagggcaggtgatgctggccgtgatgcccctcagctctggtgaggagtcaggaagctgctaacagaagccacctggtttaaggaacgcattccaagcagaagtgtcctggcttccagagggagactcaggaggaggaaaatattatctcctctgggagcagaatttcatctttccaatcagttcttgct

SEQ ID NO: 337578 - DNA, 601 bp, Homo sapiens
  misc_feature (443)..(443): n is a, c, g, or t
  misc_feature (446)..(446): n is a, c, g, or t
  misc_feature (460)..(460): n is a, c, g, or t
  misc_feature (462)..(462): n is a, c, g, or t
  misc_feature (469)..(469): n is a, c, g, or t
  misc_feature (475)..(475): n is a, c, g, or t
gccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaggaattaaatcaaaaaaaaaaaaaaaaaaaganaanaaaaaacaaacaananaaaaaanacaaanagaacagacaaacactaaccacagaacaggagaagaaggaaagaagcgacaggcggggacacacagatgtagggcagaaggagcagtactgggagccggagatcggaaggacagcgagagggagat

SEQ ID NO: 337579 - DNA, 338 bp, Homo sapiens
gccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccacctttacatactaaacgcccacagttcggcccttatcagagggtaccgaactcgagtgtata

SEQ ID NO: 337580 - DNA, 505 bp, Homo sapiens
gccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctgtctaaatcaccacgatcaaaagggacaagcatcaagcacgcagcaatgcacgcccaaaacgctcagcactagccaggacccccatggggaaacagcagtgattaaccctttagcaataaacgaaagtttaactacagctatactaaaccccagggttggtccaatttcgttgccagccaccgtggtcacacgattaacccacgtcaatagaagccggcgtaaagagtgttctagatcactccttcaccccagcta

SEQ ID NO: 337581 - DNA, 499 bp, Homo sapiens
  misc_feature (341)..(341): n is a, c, g, or t
  misc_feature (344)..(344): n is a, c, g, or t
  misc_feature (358)..(358): n is a, c, g, or t
  misc_feature (360)..(360): n is a, c, g, or t
  misc_feature (367)..(367): n is a, c, g, or t
  misc_feature (373)..(373): n is a, c, g, or t
cgatcgggtggggagcgcccggcactggtaggcgggactggacggttggcaaacagatcgcgagctgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaggaattaaatcaaaaaaaaaaaaaaaaaaaganaanaaaaaacaaacaananaaaaaanacaaanagaacagacaaacactaaccacagaacaggagaagaaggaaagaagcgacaggcggggacacacagatgtagggcagaaggagcagtactgggagccggagatcggaaggacagcgagagggagat

SEQ ID NO: 337582 - DNA, 307 bp, Homo sapiens
gccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctctgtgctgtccacctcctctgtgctgtccagctgtccacctcctctgtgctgtcca

SEQ ID NO: 337583 - DNA, 303 bp, Homo sapiens
gccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctatccgcttatccaatgggggatcctggagattcccatacaggcaacttccctta

SEQ ID NO: 337584 - DNA, 1606 bp, Homo sapiens
tctaatcgttattgattagaagcatgactcctgaaggaaagggaaataaatctcaattcatactaacttgcaacaaaacacttttaccatataaataagtatatgatttatttttaacccaaaaaatgtataaaataagtgtgtcctttactgtcaatttatcgagaagatctataatatatagactacatatatataatatatacaacatagccaaatgtatgaaaacttgacaatgtataatttggaattcacatgctacctatgtagacaggtatgaaattaagttataattttcatgagacattttcatcactgttgacacagtttcaagcattccatcatgttattttgactctttttcttttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgcaaagaaaacaaaacaaaacaaaacaaaacaaaaaaaacaaaaaaagcgcaaaaaacaaaaaaacaaaaaaaagcaaagtaaaatttaaaaatacagaaaacaaacaacaaaaaagaattcaaccataaatagtgactattattttcagtgtgtccttcatgtgaaagctattaaggaccaaatatactactgttcataagaagaaattactttctaaacagtaactgaaaatacttagagttaaacttgctgtggattttgtcttggcagttgtcatcttacattatttgtcaaaggaaatgtgtttggcagttaaaaatctttccttagatttagtggtggactttaacctcttaaataaatgttagtatatcagattgtgtccttgaaaaatattttacttgtatgaatcatgacaacgtctaaatctttactattcttctggcaaaagcatcagtaagaaagaaggcgaaaaagagaagtatagcctttatgtcagaaaaacattctttttagctgcttactttctcatgaaaagtaaagatgtttacagtgtatgccaagttttcagtttctgtataacaacaggtagaggttctaatcatattgaaaattgtgttataatggtctgagccatgttgctaggaaacaataggttccaattttgtattcctgctctcctgtgctgaaaagtgactggatactgtacaggttcatgttctctggctgcagttaaatggtcttttgcattttgctctggctttcaggccagaagcatgcatttttctacaagagcatcacaacaacatgctgtaaatatttaaagttaaacattatgtgttgatatttgaaagaaaagtactttgaatatttcatttttaaaaaataaaattgccaatgaaaaa

SEQ ID NO: 337585 - DNA, 416 bp, Homo sapiens
attggacagtgaagatatagcatatttccatcatctcaggaagttctattggacagtgctggtctagactagttctcaaagcttggtcccaagctaccagcatcagccatcacctgggaacttgttagaaatgcacattcccagctgggcgcagtggttcacacctgtaatcccagaactttgagagaaagaggagggcagatcatttgaggtcagcagtttaaggccagcctggccaacatagtgaaaccctatctctactaaaaataaaaaaataaaaaaaaactagcaggcggggtggcaggtttctgtaatcccagctactcggaaggctcaggcaggagaattgtttgaatctgggaggtgaaggttgcaatgagctgagactgtgttccgaattagtaggttcttggtct

SEQ ID NO: 337586 - DNA, 413 bp, Homo sapiens
ctccaaacttttgaaggctactttccatagcatctatgtctgatgcataggcccagtgagggtcttagtgtcaatctgtatataaaaatcagcaatgggttaatggatacaagcatatagctagatataaggaataagtccttatgttcaacagcagagtagggtgactatagaaatgtattgtgtatttcaaaatggctagaagagagatcttaaaatatttccaacacatagaagggataaatacttgaggtgatggatatgccaaatactctgacttgatcaatatacattctatacatgtaacaaaatatctcacgtaccccataaatatgtatgaacattatgtatcaatatttacttcttatttttaataagaaatataacttaaaaagatgttctataaaaagatg

SEQ ID NO: 337587 - DNA, 272 bp, Homo sapiens
agagccccattcccaggccctggtctcccgtgccgcagttctatattctgcttcaaatcagccttcagggtgcccacagcatggcccctgctgacacgagaacccaaagttttcccaaatctaaatcatcaaaacagattcccaccagaccactaacaatcaatactaaacccccataaataggagaaggcttagaagaaaaccccacaaaccccattactaaacccacactcaacagaaataaagcatacatcattattcttgcacgggct

SEQ ID NO: 337588 - DNA, 140 bp, Homo sapiens
tggtttaaggatgagatcattggaattgcagttggaattggaattaataccactgacatgatggatatggatgaagcatttcagctgtccaataagaagtcacgagacactgagacctgggtacccaacaagacatcatt

SEQ ID NO: 337589 - DNA, 646 bp, Homo sapiens
ttatagctatatcagctgagtttatactctacgttgagtttttttgcttttaaaactaaaaataatgttctactcttttctctgttgcctcatttaaggagaaatctgctatcaacctttcctttgttcctccataaaacatgtcctttgtctctgactgctttgaggatttcattttaacactgatttagagcattctggttatgactcatgtggcttagtgtagttttcttcatgcctcttgtgctcagggtttgatgagcttcttagatcagtaagttcccatcacatttggacattttttcatcatctcaaaatattgttttctgttcttttcccactttccttttacagactccaattccatgtgtgttagagactacttgaagttctcttaaagctcacaggggcttggagtctgtaaaaggaaagtgggacaagaaaagaaagacaatattccaaaagattaacatgttcaagtattgtgagaggaaaggggagattcaaaatagaatgggttcagaataagtcaattatatttactaccttaggagagacactgacacaactgttttatcccgtaatatttatgcccttagaacacatactgtttccatttaaaggcagattcctttctggagctgtt

SEQ ID NO: 337590 - DNA, 437 bp, Homo sapiens
ttatagctatatcagctgagtttatactctacgttgagtttttttgcttttaaaactaaaaataatgttctactcttttctctgttgcctcatttaaggagaaatctgctatcaacctttcctttgttcctccataaaacatgtcctttgtctctgactgctttgaggatttcattttaacactgatttagagcattctggttatgactcatgtggcttagtgtagttttcttcatgcctcttgtgctcagggtttgatgagcttcttagatcagtaagttcccatcacatttggacattttttcatcatctcaaaatattgttttctgttcttttcccactttccttttacagactccaattccatgtgtgttagagactacttgaagttctcttaaagctcacaggggcttgctttttttttttttttttttttt

SEQ ID NO: 337591 - DNA, 920 bp, Homo sapiens
attacagctgacccttgaacaacacaggtttgaactgcactagtccacttatatacagattttctgccagcctgagacagcaagaccaacctcatcacttcttcctcattaggctactcaacatgaagactctgagtatgaagacttttatgatgatccacttccatttaatgaacaatgaagacattttctgggaaaactggtacttctgtcatcactacagcagaagatgttaagaagcaagaagagaagaaaaagaagaatctatcttgactatgttaggtatagctggaacagtacttaacctcttagtgattgttttggtctacatccataccacactctgaaggtcttgttcaagggactgcattcagggcaaaacctggctctaacaagaaagatttagaaactatcctttaaaagcacacctccagaatattaagacatacatcccagggtaactcccttgctctaagagcaattactatatgatgcttccagtttgaggaataaaattataacaaagcaaacaggtaaattttaactttacacagaggaaaaaaacaggacaaagcaatgaatatggacactgaagatggactactccaaaacatacaagatttagtaacgtatacaagacacaacagcaaaaatgctacaaccatttttctaagagtacatataaaatacacattaattaaaataaaactgcatttaggtttgtgttttccttaagcctctagtaatctactgaatacaggaaagggaaatttagtcagtataggaaagaagactatgaaaatgtttagaaaaatgaagttttagttagcattaatgaacactgaatattttaaaaactgtctttggaaattatattttagtaactccaaagaaatgagccttagcgtgacttttggtag

SEQ ID NO: 337592 - DNA, 101 bp, Homo sapiens
attagaaatagttacagaaagtttgtgttttgccttgttttttaaaataatagaatcatactttccaaaatacattgtaacctactttttaatatactatg

SEQ ID NO: 337593 - DNA, 194 bp, Homo sapiens
agtctaaaactttagtacttttccatgcagatttgtgcacatgtgagagggtgtccagtttgtctagtgattgttatttagagagttggaccactatgtgtgttgctaatcattgactgtagtcccaaaaaagccttgtgaaaatgttatgccctatgtaacagcagagtaacataaaataaaagtacatttta

SEQ ID NO: 337594 - DNA, 266 bp, Homo sapiens
ccacccccacgaccccaataccacaaatacctacctctctgtccaccacactgatgtagagaaaggcatgaaggtcacagatgagaagtagaaaatgctatgttaggacatctgctgagaatcagagcaactctgtcttccaaaaagacaagagtttggtctgaacaacgccaggtactgagcttccctctgccatcaccgttgcaccaccagatgaataaggagagagcaccacttccacttgaggacccactacaactactcca

SEQ ID NO: 337595 - DNA, 284 bp, Homo sapiens
cactgttgatgtgaaggaaagtaatataaacactatgaaaaatagtatggagtttactttaaaaattaaaactacaataaccatctgactcagcaaagtaattgctgtatatgtagctgtaaaaaaaaaacgaagtatatcagaaacacgtctgcacacctatgtttactgcagcaatattcacaaaagccaagatagggaatcaacctaattgcctagtgattaatggataaagaaaatatggcatatacattcaatgaaacactattaagccataaaacagt

SEQ ID NO: 337596 - DNA, 738 bp, Homo sapiens
gtcattactccatggctgtgactggtgccactgcatctccagcctgtatgacaaagcaagacgctgttccaaaattaaaagttaaaaaatgagataaatacttgaaatattacaattattaaaatagttgttttccccatgggaaaaaaaagttgagcagagctgtgtctttgcactcagaaaaaactcttactctgttgaaggctagtgactcttctaaacaccaaccccttcacctttttactttccttagactttctttggaaaatcaaggagttagcactttttccccctggaagaattaaatgcctctccagaactgcagcacaggaggttaacttctaccacctttggaggcctgcaagctaccagattaaatacttaaagctaagcattcatcatttcttaacctgccctctacagtcatgcacttcctgctttttactttgtcagggctcgtactcaaactattcatagcttcatgaaacaggaactaaatgctgtctgagcctttccccttgtaactctcagcgttctgcttatccttcatagacagaagatgatgatatgtcctgactgttgaagagaaattagacttaatgtgatcctgtacagttaaaccaaaggccagatagggattttttatttcaatcactttctattgtaggcctaggtttggaaaaccttagcaccccctaatttgtaagacttgaactgttttaaagataagggatacac

SEQ ID NO: 337597 - DNA, 310 bp, Homo sapiens
tcaaaataaaacaaatttttattcacttaaaaggccaaaaaggattctggggccaggcacagtggctctcgcctataatccctgcacttcaggaggccgaggcaggaggatcacttgagcccatgagttcaagaccagcctcggaaacacagcaagaccaatctctacaaaaaatttaaaaattagctgggtgtggtggtatgtgcctgtagtctcagctactcaggaggctgaggcatgagaatcacttgcaacccgaaggtggaggttgcaggactccagcctgggctacagagcaatactccaactc

SEQ ID NO: 337598 - DNA, 3009 bp, Homo sapiens
tgcgcatgctcggaagagcgggcagggttcccactccgggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaatacaaatgtaccgtgtttttgttaggtacagtctggatcatggcatgtagaaatagaaatttagaattttactgcagctttgatgtgcatatttgaactttttaacatttgtaactttggtggcaaagagaattttagcttctatcgattttgtaagtcttcagctgaaccactaatagcagtcatagtgaagattagcactacttagaattaaattaggaagtcttttatcattgcaggattgtacatactactttataaaaattctcacctttgattttaaatcccagtacctagttatatctaacctatcaaaggcaagatatcatttattggacttcttgaaaataaaagttacaaaatccaacaacaacaacaacaaaacaatgttcttggttttaatgttccagttttttacatgtaggagtgtgggaatgaaggaattctggagctttttgacacaaaacctattaccacatttagcagttaaatggctataggtgggaagtaggatttagatgtatagaaaagtaagaaaatcttacttagaaaaaagccccttgaaacttgcaggatttacttaataaaaatacacgctatgagtcataattgtgccaagttgtttcatgcagtcctcaaaaattagatgtaattgagctttgtgtaatattatgtcagctttaacatataatattttgaatattttagctatatttagtggctttctgcaagcaactagaacagagaagtaatgggtcaataatcttgaccttaatttaaaactttcaatggagatagggctagaaatacttttgccaaatagcattcttattcactttatgccggtatttagaaaaaataaattatagcaagtatgatttctaagaatgtttttctataaattactaattgtaaaaagtcttgctttttaaaacaagttggtaatgcatatcatggaaggcatattttgtatgtataaattcaccacaattaaagattattcttgtcagtcctt

SEQ ID NO: 337599 - DNA, 1683 bp, Homo sapiens
tgcgcatgctcggaagagcgggcagggttcccactccgggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttttggtggcaaagagggtgcaatttgccacacgataagttctcttagatggaaaaattttttctaccaacaaaaccttggggggtggtttcta

SEQ ID NO: 337600 - DNA, 3075 bp, Homo sapiens
tgcgcatgctcggaagagcgggcagggttcccactccgggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaatacaaatgtaccgtgtttttgttaggtacagtctggatcatggcatgtagaaatagaaatttagaattttactgcagctttgatgtgcatatttgaactttttaacatttgtaactttggtggcaaagagaattttagcttctatcgattttgtaagtcttcagctgaaccactaatagcagtcatagtgaagattagcactacttagaattaaattaggaagtcttttatcattgcaggattgtacatactactttataaaaattctcacctttgattttaaatcccagtacctagttatatctaacctatcaaaggcaagatatcatttattggacttcttgaaaataaaagttacaaaatccaacaacaacaacaacaaaacaatgttcttggttttaatgttccagttgctgtgaaatagaactcctacaatcaaaagacagttttaggaagtcttatttattgattttaaaagttttacatgtaggagtgtgggaatgaaggaattctggagctttttgacacaaaacctattaccacatttagcagttaaatggctataggtgggaagtaggatttagatgtatagaaaagtaagaaaatcttacttagaaaaaagccccttgaaacttgcaggatttacttaataaaaatacacgctatgagtcataattgtgccaagttgtttcatgcagtcctcaaaaattagatgtaattgagctttgtgtaatattatgtcagctttaacatataatattttgaatattttagctatatttagtggctttctgcaagcaactagaacagagaagtaatgggtcaataatcttgaccttaatttaaaactttcaatggagatagggctagaaatacttttgccaaatagcattcttattcactttatgccggtatttagaaaaaataaattatagcaagtatgatttctaagaatgtttttctataaattactaattgtaaaaagtcttgctttttaaaacaagttggtaatgcatatcatggaaggcatattttgtatgtataaattcaccacaattaaagattattcttgtcagtcctt

SEQ ID NO: 337601 - DNA, 1993 bp, Homo sapiens
tgcgcatgctcggaagagcgggcagggttcccactccgggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttcca

SEQ ID NO: 337602 - DNA, 1382 bp, Homo sapiens
tgcgcatgctcggaagagcgggcagggttcccactccgggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttcctttta

SEQ ID NO: 337603 - DNA, 304 bp, Homo sapiens
ccatctggtgcccactagactgaatgatcgtccagtgtatgaaagagtgctaggccagatgcggtggctcatgcctgtaatcccagcactttgggaggccgaggttggcagattgcttgaggccaggagttcgagaccagcctcggcaacatggcgaaacccccatctctatcaaaaatacaaaaattagccaggtgtggtggtgtgcctgggaggctgaggcacgagaatcgctggaacagagaaggcggaggttgcagggagctgagattgtgccactgcactccagcatggatgactgagc

SEQ ID NO: 337604 - DNA, 133 bp, Homo sapiens
tttcttttactttccactctcattactgttaaccatactaaaataaatcttcaggccaggcgcagcagtggttcatgcctgtaatcccagcactttgggaggccgaggcggggggatcacttgaggtcaggag

SEQ ID NO: 337605 - DNA, 379 bp, Homo sapiens
aatccctatggattcagtttcctcatttatcaaaggaagattatagtgcatgtcttacctaccagacagggttgttcatgaggatcaaaggccatgatgtttttaagatattttgaaaagcataaagcgctgtgttaatatttgtagattgttatccacattactgctgttattcaatatgttaatgctgggctattaactgagcccagatctttctgctcctctttggctgcttttcaaaagaaaaaaatgagtgttagatttagtaaaataataacctgacaaggggttctattttttattagctttgcagtgctgtctgaagaggccaactgtctatcctttatgaaaaagtggcactttctgtgtcagttagtat

SEQ ID NO: 337606 - DNA, 317 bp, Homo sapiens
tggacttccagataggtagatgaggtaaatcacatttctgtttctacaaatcatttgacaaagtcttccccagctgactcatcagtaaagcggtgcctggctgagtatttacttaggttcatgcacagatagcccaagatccaaaaacagtgatgatgaatgattctgcggctacctaaaccagctgtccagtggaggggcacaaggctctgcaccagggcctgcctacagaccaatgaactgaagggaggcttagaaggcacacttactacattgcagatagaacgaagaaagaatagcccagtgttgcaggtgat

SEQ ID NO: 337607 - DNA, 856 bp, Homo sapiens
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggcatgctatcagtgagcccccattagaagtgccctaatcggtccattgaaaggatctgaattgacaccgcttttt

SEQ ID NO: 337608 - DNA, 1195 bp, Homo sapiens
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaa

SEQ ID NO: 337609 - DNA, 1404 bp, Homo sapiens
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaagcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgtttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgt

SEQ ID NO: 337610 - DNA, 447 bp, Homo sapiens
aagcattatctgggcagctttgaatggaaaacagtcatgaatgagcaatcaatggctattcactacaaaatggtggagaggtgactaaaagtttatcttagacaaattttatatcatatatttagttagtttcttcctatcacctggcaatgccagctcctcctctgttctttttttcctatatagtgccttcccagtcatatcctgttcctaaacccgtttaagatgaataggtaatggccacatatcaaatactagtgttatgaattagatcaacaaaatatgaaatattaaaatgtaaggattgcctatctgttgcaaatataaagttttttctcttgcaaaaattataggggatggagtgttagatctctctacaaagaaaaccagcataaaatctgaagagtcatccatatgtgatccttcttctgaaaattcagtggctgg

SEQ ID NO: 337611 - DNA, 391 bp, Homo sapiens
gcagaacaaatgggcatttagagcattaattttttgtcatttttaatggaattccatgtttgaattaaaaaataattctgtatgttgttgttttcttatacttttaggattgtataccatctcttgattcttcacagtcaacaccaacagaggagctatcatctcagggccagtccaacactgataagattgaatgccaagcagaaaattacctaaatgcactctttcgaaagaaaggtaatattggtatgctttgtcatttaaaatttgcaatagagatgtaaaatgttggaatttttttacacaaaagttttttatatgtcagtctctctacttcactctttattgtttctttattcttaatttttctttatatttttagggacagtag

SEQ ID NO: 337612 - DNA, 1498 bp, Homo sapiens
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgtttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgt

SEQ ID NO: 337613 - DNA, 1246 bp, Homo sapiens
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgtttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgt

SEQ ID NO: 337614 - DNA, 302 bp, Homo sapiens
gagattctgtcttcggaatcgacccagctctttaaaagaatgaggaaaacatggggtctttatatatcctggaaagtcgcctaggcgttcagtgaaaaacgcaaaaggcacgtggattcctatttgtgtaaaaatataaatggggcagggggttaaacatcaggttttttctgcacgaaaggtctcagcgcagagggttggagatttttcttttcattgtatgtctttcgggactgttcgaagccaatgtgtgttgcttaccatattcttgcattgaattttcaattaaaaaaagaaactgc

SEQ ID NO: 337615 - DNA, 371 bp, Homo sapiens
tttcttgtttaagactcaccagcatgagaacttaaaccataggagagatgttcttacttaggaatattactgccctgcccactatcctctcccaatgtaaaataactcatttactaactgaaatatcatcagactctacaagtggctgatgtgactagatatctttaagtcaataagacctaaggtatgtgtgtatgctaccagctttaccagctaccttgaacttgtaagaatgtctgtccctacccctcggggcaccgctggacgaccattctttctcagtctcacttttaggccttctttcctcctttctagtgcttcccaaggtgccatatcgtgatccttcactcttattcctttcttggactcct

SEQ ID NO: 337616 - DNA, 611 bp, Homo sapiens
tgcagtctggctgcttcagctttgctgagaacacatttggatcatagagcactctctaatacccccagacactgaaaatggttccattttattcagtaatggctagtcactaaatgcaaacaatgtttatctaatgggtatcgttcccagtctcattcctatttcaattcctgtggttaataagctaacatcttatcaataagctaacatctccaaaagtgggttctattgaacacttgttctatagaaattcatatatgttacttctgggattgtatcagtataatttgttataatagagtaacttgtaagcatggtatttctagtatttcatgtgacttggtgatatggtatggctgtgtcccaccaaaatctcatcttgaattgtagcttccataattaccacgtgttgtgggagggactcaatggaagttaattgaatcatgggagcggtttccctcatgctgttctcatggtcgtgaataagtctcacgagatccgatggttttataaggggaaatcccttttccttggttcccattctctctcttgcctgccaccgatgtgccttttgccttctgtcatgattgtgaggcctccccagccgcgtg

SEQ ID NO: 337617 - DNA, 779 bp, Homo sapiens
agatcagaatgatgtgttttaaatgtgtaattcataattgtacattttaatattctaaagtgacattgattaatttgacattggagtcaagtagattgattaattcaacaaagaagagaaggcattcaagtcaacagaaaacaagtagattttacttctccactgggggtgttaggacattaattatgtacttggtcttacttgtttagtagtagatctatattgagtgtcttactgtgcccaaacttaggatctttgtatatttctaaaaggatgaaactgtataataaaaacactttccaattttggtagattgtagacagatcagagtattcaaaagtatacacatcttctctattgtgaaagaccaaaaaatggaaatgtgttgtgaaattagaaaagctgtatactagtatgtctgatgttgtgagaagctggatttttgaaaccagagttgtctgttcagccttttatcagtctgtactaagtttgatgtccataggtacataatatagggaaatacataaaggataaaattaagtgaagttacatattttatacttattaggtgggtgcaaaagtaattgcggttttggcaaaaaccgcagttactttcacaccagtctaatattaaatggaactagagtcaaatagaatttagcgattgccagttctgttccacagatttcaaagtacactaaggaaaatttcagcaaattgtgcatggctgttttacttgggggagagtaaaacggccataataaactaaaaaataaaaa

SEQ ID NO: 337618 - DNA, 164 bp, Homo sapiens
ggtatgtggtcttttataagtatctagtccctgagtttaaaactattttgggaataagaataattattaaagtacctctttcaatgttaggccaagatattgctttcctagaacagcctagacatggatttgcgatgtcattaaccatctgtggtctggtaaaa

SEQ ID NO: 337619 - DNA, 379 bp, Homo sapiens
tcccaccaagagctaagcagaatgaatgaaagactcatgaaattttatgacactgggtgtttttaaaaaggtcctgaaagttccaaggaggagaaaaagcttactcacaaagagatggaatagacttccagaatcaattacacagagtgtaagaagatatccctttcaatcctaacaagggaaaattatttttaagctagaattctacatacacccaaactgagaaataagtgaaaagttaaaataaatgcattttaagatatacaacaattctacattatatatcactttgagaaaaacaaaatgaggatgaaaactgaaaaagaggaatatccaactcaagtccaaaaactgcatttaatctataaacgcaggaaga

SEQ ID NO: 337620 - DNA, 429 bp, Homo sapiens
cagcttaataaattccactcttcgagtttctttgggtattttagaaactgatttatacatacaatatctctctcgaaatgagacaatcaacacaggataaaattattgagttatgaaaatcagggtcagacagaggtgcagcactttaaattaaaccggcaaaatatatctttcatactaaattgactctttttgtcttggaaataaatgtttaatcagttaagacgctgaagttgagagagaagccttaagcatatttaattttgtaaaaggggttcgattccaatactgtacatgactcctgctagctgccataccttcaaagcagaaagctaactcccacccacgcctgcaaggctgaacaggccagggcaggggaccggaaagaattggtggcctctgggatcagagccaagggggctttggcat

SEQ ID NO: 337621 - DNA, 201 bp, Homo sapiens
agccgggggcgcgcacacagacccgagctcagccaacactcactccagcgggggacacgtgcacagaccggagctcagagcaaacacttactccagccggggacacgtgcacagacccgagctcagcaaacactcactccagccagggacgcacgcacagaccggagctcagagcaaacacttactccagccggggacgcg

SEQ ID NO: 337622 - DNA, 289 bp, Homo sapiens
catgagccctggtgctggcaaatactaccagaaaacatctccccttcaacagcttggatctcatcactccttaatgtaactaataccatgaattgctcatataaattcagtaacatgcacctactacaggtaaagcagtattcttaaccctgcaagggcaggagcagtgggtgtagtatgagtcaggagccctgcactcaaaggtattatggtctgttagggtataggaaatgggcctgagataagtatactaataaccccaataaattttaagcaccataagagaggt

SEQ ID NO: 337623 - DNA, 429 bp, Homo sapiens
caactcaactgacacacacaaaagacacaaaaccagcacacgcaaacaatcattgctagccctgtgtatagtggcacgagggaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccaacccaccccaccccacagcagggctcctggcccccac

SEQ ID NO: 337624 - DNA, 2618 bp, Homo sapiens
aggccgcggaggcggaggccgaggccccggcgcagcggggcgcgccccgggcccaggcccggccccagccgccgctgcggagcccgccgggaccccccggagcgcggccacggcgcagatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggcaccaacgtgtacatcacaagggcgcagctgatgaactgccacgtcagcgcaggcacgcggcacaaggtcctactgcggcggctcctggcctccttctttgaccggaacacgctggccaacagctgcggcaccggcatccgctcttctaccaacgatccccgtcggaagcccctggacagccgcgtgctccacgctgtcaagtactactgccagaacttcgcccccaacttcaaggagagcgagatgaatgccatcgcggccgacatgtgcaccaacgcccgccgcgtcgtgcgcaagagctggatgcccaaggtcaaggtgctcaaggctgaggatgacgcctacaccaccttcatcagtgaaacgggcaagatcgagccggacatgatgggtgtggagcatggcttcgagaccgccagccacgagggcgaggcgggtccctcggctgaagccctgcagtaacccgcccagcctcccgcggggccgcacacttcccctcccaacacacacacacacctgccatcttggtcatgagctactgtctgtccctccccaggacccgcggtgggtgctgcatgttcccggccctctgcccctcctgtcctaccccctttccccaccgagagctgggccgggagaggaccgcagggcaggtggcgtgaggtccgtgttgccttctttaacacacactcgtgcagtgggggagttctggctccccaacctaacccctagccgtcatctccacactcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccagctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccaacccaccccaccccacagcagggctcctggcccccac

SEQ ID NO: 337625 - DNA, 524 bp, Homo sapiens
ggagactctcggtctcctgtgggcagacggtctcggaggatagaatgagaggctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccaacccaccccaccccacagcagggctcctggcccccac

SEQ ID NO: 337626 - DNA, 1468 bp, Homo sapiens
aggccgcggaggcggaggccgaggccccggcgcagcggggcgcgccccgggcccaggcccggccccagccgccgctgcggagcccgccgggaccccccggagcgcggccacggcgcagatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggcaccaacgtgtacatcacaagggcgcagctgatgaactgccacgtcagcgcaggcacgcggcacaaggtcctactgcggcggctcctggcctccttctttgaccgggcgcctgacaaacgttctccacccgcagccaaactcaaacggctgtttcacggcctccaaaacccaacgacgcgtcttcaaacccgcccccagctcgtgcacacgccagcgtgcacagccggt

SEQ ID NO: 337627 - DNA, 2800 bp, Homo sapiens
  misc_feature (2560)..(2560): n is a, c, g, or t
aggccgcggaggcggaggccgaggccccggcgcagcggggcgcgccccgggcccaggcccggccccagccgccgctgcggagcccgccgggaccccccggagcgcggccacggcgcagatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggcaccaacgtgtacatcacaagggcgcagctgatgaactgccacgtcagcgcaggcacgcggcacaaggtcctactgcggcggctcctggcctccttctttgaccggaacacgctggccaacagctgcggcaccggcatccgctcttctaccaacgatccccgtcggaagcccctggacagccgcgtgctccacgctgtcaagtactactgccagaacttcgcccccaacttcaaggagagcgagatgaatgccatcgcggccgacatgtgcaccaacgcccgccgcgtcgtgcgcaagagctggatgcccaaggtcaaggtgctcaaggctgaggatgacgcctacaccaccttcatcagtgaaacgggcaagatcgagccggacatgatgggtgtggagcatggcttcgagaccgccagccacgagggcgaggcgggtccctcggctgaagccctgcagtaacccgcccagcctcccgcggggccgcacacttcccctcccaacacacacacacacctgccatcttggtcatgagctactgtctgtccctccccaggacccgcggtgggtgctgcatgttcccggccctctgcccctcctgtcctaccccctttccccaccgagagctgggccgggagaggaccgcagggcaggtggcgtgaggtccgtgttgccttctttaacacacactcgtgcagtgggggagttctggctccccaacctaacccctagccgtcatctccacactcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccagctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgtngacccagccgcaaccccgaggagacaccggcgcccgacagcgcaagcggacgaccccaacgccacaaaaccccacacgcgcaacaacggacggagagaccggacccgacccggagggccccgcagccacgacaatcggaccgcaccagagcccgacgacgacacgacaaagcgcgagcaccgacccgcacgacaatgcacagccacacacgccaccaccgccacccacccggcgcccgga

SEQ ID NO: 337628 - DNA, 515 bp, Homo sapiens
ctccatgtcccctgcccccaggaacacgctggccaacagctgcggcaccggcatccgctcttctaccaacgatccccgtcggaagcccctggacagccgcgtgctccacgctgtcaagtgtgagtgttggcccagctggacgaggcgtgggcccggggcacgcaggttgacgttttttcccagccttggctctcagagagggctagagttcagtgttgagaagcattctggggctcattctagccttgctgggaaaccggctgtgattgcttagagatttcttcgtgtttgggggatgcacgtgccgaagggaagccagggagcctgtgtcaggcaggagggtctcgaactcagggcagtctgggagggatgaggcagccagacagtgctagccactcgtcatggggggcatctagattttcaagtgaccactccccgttactaaattctggcaaatgatccgaatttttcaagaacacggggccatcccatcaaaaccaacacatccccacaca

SEQ ID NO: 337629 - DNA, 378 bp, Homo sapiens
caatgtacgtcgttgctcttaaatcccaggcacccggccccctgggcccctctgactgagctccagttcccagccaatgccatgctcctggctcgctgtgctgcagatagctgtcccctccttaagccccaagctgagacctggggaagccaagatcaatggcatgcatgctaccgctgtcccctcccaagctgaaggcaggcatcaacaatcaatcatgggaatcgactggctaaggatcattttaatggaactataattccaccaaaatttaaggaaaggcagaagttgatcgacagaagtcctaactctagacagctccccagaagttcgttcccctaaaagtgcatttgctcctcacctacacatgatggtgtg

SEQ ID NO: 337630 - DNA, 286 bp, Homo sapiens
acagggtgtgctgggcatcaaggtgaagatcatgctgccttgggacccaactggtaagactggccctaagaagcccctgcctgaccacgtgagcatcgtggaacccaaagatgagatactgcacaccaccccatctcagaacagaagggtgggaagccagaaccgcctgccgtcacccagccagtccccacagcgtaacagggtctccttggcagctgtattctggagtctggatgttgttctgtaaagatctttaataaaatattgtacaaagacagaaaaaaaa

SEQ ID NO: 337631 - DNA, 322 bp, Homo sapiens
acagggtgtgctgggcatcaaggtgaagatcatgctgccttgggacccaactggtaagactggccctaagaagcccctgcctgaccacgtgagcatcgtggaacccaaagatgagatactgcacaccaccccatctcagaacagaagggtgggaagccagaaccgcctgccgtcacccagccagtccccacagcgtaacagggtctccttggcagctgtattctggagtctggatgttgttctgtaaagatctttaataaaagcgatgcggccgaatatactaaatattaaaacagaagtgatgacagtcccgacggatggg

SEQ ID NO: 337632 - DNA, 257 bp, Homo sapiens
acagggtgtgctgggcatcaaggtgaagatcatgctgctaagactggccctaagaagcccctgcctgaccacgtgagcatcgtggaacccaaagatgagatactgcacaccaccccatggtgggaagccagaaccgcctgccgtcacccagccagtccccacagcgtaacagggtctccttggcagctgtattctggagtctggatgttgttctgtaaagatctttaataaaatattgtacaaagacagaaaaaaaa

SEQ ID NO: 337633 - DNA, 320 bp, Homo sapiens
acagggtgtgctgggcatcaaggtgaagatcatgctgccttgggacccaactggtaagactggccctaagaagcccctgcctgaccacgtgagcatcgtggaacccaaagatgagatactgcacaccaccccatctcagaacagaagggtgggaagccagaaccgcctgccgtcacccagccagtccccacagcgtaacagggtctccttggcagctgtattctggagtctggatgttgttctgtaaagatctttaataaacctaggtgcccgccgaagcgctgttctcctcgctctggcgcgcgcaaacgcgcacggaa

SEQ ID NO: 337634 - DNA, 501 bp, Homo sapiens
gaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagata

SEQ ID NO: 337635 - DNA, 398 bp, Homo sapiens
catcagtatgaactcgtggattcttttgttattcattgtactataagccattcctgtcattattcattttgattcttaaattgtcctattcttggccagtgggagtctttcatgctagctcctatgtctttttgtgtctctatctccttcagttctgctctgatcttagttatttcttgtcttctgctagcttttgaatttgtgggctcttgtttctctggttcttttaattgtgatgttagagtgtcgattttagatctttcctgctttctcttgtgggcatttagtgctataaattttcctctacacactgctttcaatgtgtcccagagatttgggtacgtcgtgtctttgttctcattggtttcaaagaccttatttctgccttcatttcgtta

SEQ ID NO: 337636 - DNA, 623 bp, Homo sapiens
taaaattgatctctattcagtttccaacccactaactccctctcccaaactgaaaagtgtcgttctttaaaattgaagagaaccttgtctcaccatacaaaggaaacaaatcaatcaacaacaacaacaacacacacacacacaacttcttcgtggtcttttccctctattacttaatttccaaattggccttgatatttctgattgctctctttttccctttccacttctgcctcatgagcaatcagaaatatcttaaaccttgccactgacaggcgcatcacctcgtatctattactgttttttaggaacttgccaaaggagcaggatctctattcactgaaacatgtttaacttttcttggagttttcatgtaaaacctatttcagggcaaattttgccatcttacattcattaggggaaaaaaatcctaggagggaaaaattgaaaaatagtaagtattaccttttacaaattcagtgttttcaacaaaagtatttaccagaagtgcatttaaaaaaaaaaaactgtaccctctaatgcttctttgaaaataacaatatttaaaataaagtcttagataattaggtcatttcaaaatattttcattcaagttatgcttg

SEQ ID NO: 337637 - DNA, 144 bp, Homo sapiens
gaaactggagatcaaagatgacgcttttatgcgagaaagcaatagaactccaatcaaactgtaagaaaatgttctacaacaaaagattgatgaatgaatgcagagagaaataaattgatggcctcgttggcctcattcagctat

SEQ ID NO: 337638 - DNA, 87 bp, Homo sapiens
gccacttttaaattatttccacttctaatgtgctaactttgatcttaaaaatccttcctgatgctacacaatatgtgattgtaaatg

SEQ ID NO: 337639 - DNA, 807 bp, Homo sapiens
aaaaaaaaaaaaaaaaaaaaaaaagatggggtgtcgctgtgttgctcaggcttgcttctgtttcaatcaagcctcatgatactggtcagcaagcactcacaatgggtgctacactgtctccctgaccctctccctttccaggactgaagctttcacacccccagccagcagctggcagtccctccccaggaactgtccttcccgggagagccacctcacccaaggtcacgcccacaccctagaggcagctcacattcactaagtccctcccctcaatgcgggacaactctgaaggtccttgcagaccagggcgcccctccattgcaagtgcaggcagcccagcttttccctgtgctcacttctccctctcccatgccagtgtgcgtcttgagggcactcccagcaaacttgctgcacacaaacctcagtctcctggggagcctgtcctgcaacagcttattaggtaccaggcacgatcctaggcactttacgcatattatttcatactatcctcccaacaaccccaagaggcaggcacttttattatcaaaggctatgtaacttgtccaaggtcacagagctagcaagccagagagccagggttgtcatgcagggagttgggctccggggctctgaaatgttacaacactgtcttaattcctatagtctagcttgaggaaattagacagaagaaacagtgaagatgtattctgatttgaggggggaataaatctcagccgggcacggtggctcatgcctataatcccagcactttgggaagttgaggcgggtggatcatttgaagtc

SEQ ID NO: 337640 - DNA, 286 bp, Homo sapiens
tccatttaaaaaacaaaacacaacaaaaaaaattcaatttgccattcaacactggaagcttatgattaaataaatgcaagttaaagcagcattaaggtgttacttttaacctaaaagattgaccaagttttaaaagtttgataaatgcccagttagtgagcaactagaccattctcatgcccattaagagggaatgtgtattaggacatactctttggaaggcaattgggtaatgtttattaaattttaaatacatactttatgacttggaattagacttgtagga

SEQ ID NO: 337641 - DNA, 159 bp, Homo sapiens
acaaatcattatctccaaattattggtatgaaatcatatcaatgcttggggctttaaaatgggtgggctgatgtggagaagaaaaaaaattgaaaaacagaatgtctcctaaataataaataagtaaaatcaaattgtaatttaattcgaatcctacca

SEQ ID NO: 337642 - DNA, 457 bp, Homo sapiens
ggggcgactctttttaactctggagttggagaatttccaaatggaaaaataagatatgcatatcaaggaaagctaaaaccttctattgaatgcatggagataggataggcattcactgagttaatatgctgtggcctactagtctttgccacattctctatgtcaccatcaactttctcaggccaagtaaatgcacctcgtctacttgatttctgccttttcttgaattcaacagcaggtgattgacagggtaaaactgttgtttcttctcaactttctgccctgttttttgtctgaggtactacaactaaagaaaaataacaggttatagaaaaaggagcagttatttttaaaaccaccaacacaaatctttggaataaggtgctgtacactaggaatagttgtttaaggctgtctttagaatatggtgaatttgaaatctgaacctgctttttct

SEQ ID NO: 337643 - DNA, 619 bp, Homo sapiens
ctggacaagaacattttcaagtaaaactgagttaaagtcagagaatgtcaaaagcagctagaaaggtgctcaagtctctaagagggttcaaggaaaggaggcataaagaagaacacctttgtctcttcaaggcaaaggtgggaaggtttcatttgtgttgaaagattttaagatttctttaagttgctttcacctggagccaagatctcctaatttatctcacagccagttctttcacctcccccagcctgaaatcatccaagtaaaagatactcataaaaaggtagacacataccgcttccccttctgtcttgattatcatctaggaaccattaccggtgtcatccaggctatccagggagagacagcaggtcaggctctgagacatgccttccatccccacctcatctaccctatgcccctgataagggccaaagggctatgttccttcattcctttgcttccccaaacctcagtctccaatatccttatttatcttctaggtttttgcaatcgcctgtgtgttttctcattcaagaaacttgagtaattgtttacaaaccagaatgtcctctgtactgagcagaagaaccctgcagtcctttgaccaggaaagcaa

SEQ ID NO: 337644 - DNA, 368 bp, Homo sapiens
ccaggctttccacactgctgttccctctgcccagaatgttcttccccctccccgccagctgttcagccccatcattcctcaggcctcagcttcaaggtccggtcagcatgctgtgtgcgctcacaagcttctagcttttttctcttgtacagtgcttcccacagctggaatcaacacatgcttaatgccactgtttgctgtctttccctctaaatgggaagccccctgaggaccagtacctcatttgtggtgttcactgtggtgcccccaatgcctggcttctagtgggtgctggacagatgtctctagaacaatggaatgcattggtttgaggacagcgcagttaactcacagccctgagtggggag

SEQ ID NO: 337645 - DNA, 304 bp, Homo sapiens
aagaatcgatattgtggttctggcactgctaaaggtgccatgatgagttattttaaaaacatatacaatctggttcttgtatttaaggaattttcagtataactaaagacacatggtaactatgtaaggactgactttaaaatatccataaatcaaagacttcccggatgaagctctgattacacccagccaccccggactcctggctgttccagcagtctcgcccagcacctacatccctgccgctctctgctttgattcaccccacaaacgccagaaccacaaatatcgccacatctagacc

SEQ ID NO: 337646 - DNA, 154 bp, Homo sapiens
gtggaacaaatccccacatttgattcttttctctaagagccttttaaggaaattgtgactctgtgttagagccaacgggctatatcctattagttcatctcactcccttctgccctgtgccccttgccccctgccttattaacattctatggtt

SEQ ID NO: 337647 - DNA, 110 bp, Homo sapiens
ttaggtacgcagcatcattctagaagggaccccctagttgcctggtttcaagaggtcataatggctattccacagatcccttctactcacccattatttgaatagtcaaa

SEQ ID NO: 337648 - DNA, 89 bp, Homo sapiens
cttcccaagagtccctcaaatgctgctgccctgcctggtcccaggctctctagactcaggcgactgaagctaatcacttcatctagttc

SEQ ID NO: 337649 - DNA, 246 bp, Homo sapiens
tgaacaggagggaagagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcct

SEQ ID NO: 337650 - DNA, 338 bp, Homo sapiens
ctcattggcgggcaagggcatcctgggaaatgccatcaagtggaacttcaccaagttcctcatcgacaagaacggctgcgtggtcgcggggcgcgttgtgggattacaggcatgagccactgtgcctggttagcacagaagttttacatcttgatgaagtgcaatttattttttattttgttgcttgtgcttttggtgtcctatctaaaaattatttcccaaattcagtgtcatgaagatatacctctatgttttctccaaagagttttatagttttcacctcttacatttaggtccttgagccattttgagataatttttttttttttttttttttt

SEQ ID NO: 337651 - DNA, 582 bp, Homo sapiens
tccctaagctatcagtaactttcttcttcttcactactttaggaagctatcatatagtcatgtgtatcatacagtcatgtattgataagtcagtggaactatttttgatattttacggtaattccattcttcccaattttctgtaacagttttattttcaacagtaggtttaaatgaagatgttttatttctgacttcattttgacattgaatctaaatctatgcttcccttatgttgaaccattcaattttctctaatgttcccctaaagttcaaacttcgtatatttctttttacgtggattcacaagccatcttgaatgagtggttcatgcaaggaagcacagacatacttatagacaacactaaaagtgttgcaaggtttcctgcaataattcctgaaggcggttccactggtagagctgatacaagcatactgcacagagaaaccttaaaacctctagagaagaaaggatggggctagaaggtcaacagtagtagtagctagcacagccaatttgaaggaatgtgaaaatatagaacatataacttttttcttgttgcttggctgggaagtaagtgt

SEQ ID NO: 337652 - DNA, 161 bp, Homo sapiens
agttctcttctagtcttggtttgttgaatatttttatgataagacacttggattttgtcaaatgctttttccctatctattgagatgattatgtgggttttgtctttcattttattagtgtggtatataacactgatgttcatagactttttttttttttt

SEQ ID NO: 337653 - DNA, 541 bp, Homo sapiens
aggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacacgacacaaaagctgataccagagctatacagctgctattaggccagtgctgaattagtccaaagggcggacaag

SEQ ID NO: 337654 - DNA, 578 bp, Homo sapiens
gacacggcaccaattatctcttccaattaaaccaccgccacaggatgctaaatccagtgatatgaaccggcagcaggatgcttgcccagcccagggctggcatttatgatccttattagcaggaaagctctgtcttctgctccccacggctcagctgtggaacctggagctcccaccagcccccacagcaggtgctctgggaaggggcagaagaaaatgatggcaggacttggagaagccaggacagcagagtcaacagttccaactccattggggaactttccccatcgatgacagcaatttccctaacatctaattataggcattttgtcagctaaataataagttgcatggattaaatgcctacagtgagccaggaactccaagaagtaccttgtgtaatttcatctaatcctcgcaacaaccctctgaggcaattcttcattgcccatcctcattttaaagatggggaaactgaggctaagagaaacctgccataggtgggtagacctaggactcaaagccaggtggtgtctagctccgaagtctgcacttcttccattacaccacagcagacc

SEQ ID NO: 337655 - DNA, 450 bp, Homo sapiens
ctcccagattccagatcccaacagagcatctggtccacccactgttccccaacacaatgatactaaaagaccctgagagtctacgcatttgtcccctttctctgacctaaaaaagggaggtgccacaacttacagtttttctgtatgtctcacttaaccccccacacccatcagacagaagggtgttcactctcttcctatcctgggtggaagtcaaggacagtgcagtaactatgaaacagtacttcgtatactgaaaattgcttttgaaatctctcctcagcatctgcccgtcccggcccaaactcctcactcccttacgctgtgtctgccctgggaccgtctctggatttctgctctgatggtgctgtggttttgcagctcactctcagctgcacccacgcccccggggaggggagggtctgtctggtgcctcactgctgtagtctc

SEQ ID NO: 337656 - DNA, 765 bp, Homo sapiens
atccatccacccattcgttagctatttatccattatccattcctccatctatccatcatccattcatcccttatccattcaaccattatgcatttcttcatttatccattatttatccttccatccatcatccatcatctttccatccactatctatccattcatccatctatccatcatccatccatcctttatccatcattcatcagccatcatccctccatctatccattatccatcatccactcatccattcatccctccatctgcccattatccatcaaccatccatccatccattatccgtcatccacacatacattcatccctccatctgcccattatccatcaaccatccatccatccattatacatttctgcattatccatttattctttatccatttcttcatctattcatcatctatccatccattatccttacacctatctatcatccatccattccttcatctatccatcatccatcaattatccatccattcatccatccatctatccatcttctattgattgcttgtcatccttccttgtatcagacttccatccatcctccttccatgtgtcacacatcctcattactcaaccatccagctgtgcatccatctattcactgatatagttcactgtgcccctactatgtgccaagcactgtggtaggcacttgaggtgggatgctggagcatccagagagggcatctattgtcgtgagcctgggttcagattccaccttctccacttgtg

SEQ ID NO: 337657 - DNA, 206 bp, Homo sapiens
tgtggctcagtactccatgatgtacacgcactcacattttccctctccaccctcgcactccaaacacccatctccatcatcaatgctgcagggagcattctcctatatgtctccttgtgaagctgtgtgagagtttccttcacacacacacacccgacacccaggggtggaagtcacaggctcacagtatgcaaataattattttg

SEQ ID NO: 337658 - DNA, 493 bp, Homo sapiens
tgtttctttagtatggaattagaacttaaatttccagaaaaatagaaggaattgatctaaatcctgttttgctctttgttctagtgtcaggggtttggggctaagtattaggaggcccagattcttaacttagccactagcaatatgaccttagataatcctcataaacctcactgtacctcagtttcctcatcagatgaaatgacagaggaatgcagtcccttccaactttaaaatgattttggaaggaatcctattcgaaattggctagaaaaaagtggactgtgacttaagggatgagacacagaagtctgaagtcaaacacactattatttggaagcttactgacctacctatgtttacaaagtatgtgtaatgttttttagaaagcagcataacactgtgtcttagggtcacataacttgacaaaggcttaaattctttgcctcggctttccattattaaccaatgaactctactggtggatctttgt

SEQ ID NO: 337659 - DNA, 864 bp, Homo sapiens
  misc_feature (29)..(29): n is a, c, g, or t
atcaggctaggtacgaggcctgggtggtngccgacgctcctggccgaataaaaaacctcttccttctttaatccggtgtccgaggagtttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgccaacaaaaataacagcaatggggcttaaacagagcatacgcccacaaggacaaagaaaatgatggaggagacaagaacaacacagtcctggaagctggagggaggaggacacattcagctgactttgcagatccaaaaatgcagacttcttctcagctggtagagtgggaggtgaaaagcaaacttattacactgcagaacaccccaaatactcaggaattgatggttccaggaattgcagcaaggtggggctataaaaactcagctgggagtctgcttaggaagcatttgtcttccgttttctccttcatcctgcaacagctgaagccctgccc

SEQ ID NO: 337660 - DNA, 869 bp, Homo sapiens
tctttgtgactaggtacgaggctgggttggcgctgtacattcctgggcgccgtagatatacctcttccttctttaatccggtgtccgaggagtttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgccaacaaaaataacagcaatggggcttaaacagagcatacgcccacaaggacaaagaaaatgatggaggagacaagaacaacacagtcctggaagctggagggaggaggacacattcagctgactttgcagatccaaaaatgcagacttcttctcagctggtagagtgggaggtgaaaagcaaacttattacactgcagaacaccccaaatactcaggaattgatggttccaggaattgcagcaaggtggggctataaaaactcagctgggagtctgcttaggaagcatttgtcttccgttttctccttcatcctgcaacagctgaagccctgccc

SEQ ID NO: 337661 - DNA, 767 bp, Homo sapiens
gctctcaatccatcacgaccctttcacgtggaaccccttagagttgtaagcccttaaaagggccaggaactctgtcttcggggagctctgctcttaagacgcgtgtctgccgacgctcctggccgaataaaaaacctcttccttctttaatccggtgtccgaggagtttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgaaactcattaatcttcaaaggcttcaagagtggcacagatgaatccaatattcctatatgacctactttactgaactggaaaaactgcatgctgacagcacaaatgatctgtaagaagagatgcaggttgtatatgtcagcctcgcagagaactctttcc

SEQ ID NO: 337662 - DNA, 726 bp, Homo sapiens
  misc_feature (29)..(29): n is a, c, g, or t
atcaggctaggtacgaggcctgggtggtngccgacgctcctggccgaataaaaaacctcttccttctttaatccggtgtccgaggagtttgtgtgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgtaggctgcctgctaagaaagagtagacagacccaatgtcctccgatcagtctggactcagttcatccttcccctggtacagaagagctgcgtcagtcattctctctgtgatctactgataagagtcctggacggggaattccaaggccatgggtctattcccagccttgccactatgaatgtgacctccagcagttagatcccctgcctgcagcacgtgctgatctccaagggtgaggctggatgaagccaggggctatggaaagggagactg

SEQ ID NO: 337663 - DNA, 867 bp, Homo sapiens
acacccatggctaggtcgaggccggtgtacgagccgacgctcctggccgaataaaaaacctcttccttctttaatccggtgtccgaggagtttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgccaacaaaaataacagcaatggggcttaaacagagcatacgcccacaaggacaaagaaaatgatggaggagacaagaacaacacagtcctggaagctggagggaggaggacacattcagctgactttgcagatccaaaaatgcagacttcttctcagctggtagagtgggaggtgaaaagcaaacttattacactgcagaacaccccaaatactcaggaattgatggttccaggaattgcagcaaggtggggctataaaaactcagctgggagtctgcttaggaagcatttgtcttccgttttctccttcatcctgcaacagctgaagccctgccc

SEQ ID NO: 337664 - DNA, 943 bp, Homo sapiens
gctctcaatccatcacgaccctttcacgtggaaccccttagagttgtaagcccttaaaagggccaggaactctgtcttcggggagctctgctcttaagacgcgtgtctgccgacgctcctggccgaataaaaaacctcttccttctttaatccggtgtccgaggagtttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgccaacaaaaataacagcaatggggcttaaacagagcatacgcccacaaggacaaagaaaatgatggaggagacaagaacaacacagtcctggaagctggagggaggaggacacattcagctgactttgcagatccaaaaatgcagacttcttctcagctggtagagtgggaggtgaaaagcaaacttattacactgcagaacaccccaaatactcaggaattgatggttccaggaattgcagcaaggtggggctataaaaactcagctgggagtctgcttaggaagcatttgtcttccgttttctccttcatcctgcaacagctgaagccctgccc

SEQ ID NO: 337665 - DNA, 749 bp, Homo sapiens
  misc_feature (29)..(29): n is a, c, g, or t
atcaggctaggtacgaggcctgggtggtngccgacgctcctggccgaataaaaaacctcttccttctttaatccggtgtccgaggagtttgtgtgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgaagaacgaccacacttttgcgttaaggttaagactctctgagtttctgaagccttgcagaagtaatctttgcctagctttgggaagatctgacccactacagattatgttagaagtgccagaggaggaagacttcctgtacccgtctgttatggagctaaatcacatcagtcacactgtgacatgtgatgaacagacatgggcgccatagtaagtcagcagagcccagagcaatgagtatgtctggaaggaggagactgcccaaagctaactgtggggctgtgcgttgaaggatga

SEQ ID NO: 337666 - DNA, 476 bp, Homo sapiens
ggaagatagctgtgaataaactgaatttgagtgtacatttaagttggtgataacagaattgtagatgttatagaagtataattttacaggtaatttggaggaagttcataaatatatgaaaacctgcatttgtagccatagaactctaattttaatgccaagctctcattaataattaactgaaagtgtctacacaatggaggcgtttcttcgttatgcaaatatctactcagtacatgcaaagttttagggaaaggtcttgtaaaaattgcatatggtggatagcttatatagcaaattcttattgagcatattctgtttagaagacacgtatccccattataagtgttgggggaagctaggcgtgttggcttattcctgtaatcccaagctactcaggagactgaggcagcaggatcacttgaagccgagagttcaagaccaacctgggcaacgtagtgagaccctaattgtag

SEQ ID NO: 337667 - DNA, 355 bp, Homo sapiens
gccctggatccagagggggtgggaccacatctcgaaggaagacagagggaatgcagcaaaaatgggcaaaggcaaaccatctaactagagggccaaaaagtggagtgagctcccacctgatggcctctatttactctgtgcagtaagatggagatcacgtagggaggagagctagatgttaaaattacaagaattctatgagtaggttgctaaacacagacattaaaatagtgaccatggtgtctggaaatggtagctcgtgcctgtaatcctagcactttgggaggccgagtgggagggtcgcttgaggccaggagttcaagaccagcctgatcaacatagtgagaccccattt

SEQ ID NO: 337668 - DNA, 2524 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337669 - DNA, 461 bp, Homo sapiens
gtctcttgatggatcccttcgactgtgggctcagtaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337670 - DNA, 489 bp, Homo sapiens
agatgagtgtgctggctccagagcagtgtggtgactgaatgtccaagcaagaggacatggctgcatcagggagatagacactttgagacgggagggcaaagaaaggggagttggggttacccaggtgcagaggagaccaatagccgctgtgctctgggttttcagggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337671 - DNA, 498 bp, Homo sapiens
agtagataggccacagatttcgcacttttatagccctgctttattttgttactgtcatcctgctgacacactttcgggtctgttagatgcacccacccaattccttttctgttttccagctatgtctccaatgggtctgtctactttgatacagcgaagtttgcttctagcgagaagcactcctatgggaagctggtgcctgaggccgttggagatcagaaagcccttcaagaaggggaaggtgaggagggcatgcctgagagcatgtgggctctccctcctggcccagcctgggttgtgttgactttgcaggccacgggggctgcgctgagcccacccctcagactcttgggaacagtgctttttcacctgaaggaattttaggagttttctgcactcaacattgtgcagctctaagaccatgacatgtgtttttttaatggatatataataattatgcaatttatggggaacatgtgatgtcttaatacatgcaaa

SEQ ID NO: 337672 - DNA, 410 bp, Homo sapiens
ccaccatctatcttgtacccggtggcccaaaaacagtttgcccagctgcctacctgatagctccactgggccaggaagcctctgatatctaggctgtccaaagtaaatgtgattttcaactccccaaacttgttcctccttcctgccatggagggcgtgcctacctgatagctccactgggctgggaagcatctgaaacctaggctgtccaaaggaaaggtgaaaatgtgattttcaactccccaaacttgctccttttccgtcagtggagggcatgtctgtttgtgcaatggctcaggccagaacctcaaagcaaccgagggcttccctcaccggcacccagcctgctggctccactaataagctctccctgcagcatcagactgtcctcgcccctgcccgggtgctgc

SEQ ID NO: 337673 - DNA, 2553 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagggcgttggctgtcttgtgtccccccacagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337674 - DNA, 2773 bp, Homo sapiens
cggcgtggggcgcgacttccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337675 - DNA, 2541 bp, Homo sapiens
  misc_feature (9)..(10): n is a, c, g, or t
gtgaaactnngtagacagaaacaccttattaaaagagagagaagaaaagagacaagtctccaggtgaagaggcgacttgcacttcctggtgctgcccctggaccctgatcctgctctctctgcctcccaggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337676 - DNA, 2820 bp, Homo sapiens
cggcgtggggcgcgacttccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337677 - DNA, 2387 bp, Homo sapiens
ttgagtagactgaggaggagaagggggggtcttgctgtttcagggatggcagagaaaatcatatataaatgcactcatgcagttcaaacacgtgttgttggaggttaagctatacatatcgtctggtgtggaaatgtttgttttttcattgctttaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337678 - DNA, 1974 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337679 - DNA, 2487 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcctaaattaagagttgtgttcatgtaggttcgtgtcgtcgttggctctgagacattgataataaatttttctcaacagtgaaacc

SEQ ID NO: 337680 - DNA, 3155 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagtaatgcattttgtttgggggtgagggctctactgggcaggagtgcaccctgaccccatgccctgtggctctctgtgcctccgtggaccttagccaggcccctgcagaccctcacagaaggagctccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatgtaagcatgtaagcatccttctcttctattcagaacttgatcagaccacattaaagtgggaggacaggaattttcaaccttggacaagcagattttctgtctgtagaaaatttggaatcaaatctgacacccgctttaggtccagggcctcctggcccaactactgagctccttccacagcccaggcagctaggcaagcccgtgccagggccccctccactggtgtggtgagctctggtccctagccctgggagttgtggccccgggcaaggatccacccaggccctcacaagctggctgaagtgccgtggcgcagataggcctcctacccccagtttcttcctttgtcatagcgattcacagccactgcctccaaacctctaggcccctccctgctggcatttggatgtgtttgctatgtacctttgggccagctgtgtcagaactcagccatgggtaggctctgag

SEQ ID NO: 337681 - DNA, 2260 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtg

SEQ ID NO: 337682 - DNA, 1790 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337683 - DNA, 1472 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcggggagtggggggggcccccagccgggaggcacctgggtctccacgaaccggggcgcgtcaaaagaaggtgaagagtaagagaagaaacaggcccggggaacagggg

SEQ ID NO: 337684 - DNA, 1249 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgaggagggcatgcctgagagcatgtgggctctccctcctggcccagcctgggttgtgttgactttgcaggccacgggggctgcgctgagcccacccctcagactcttgggaacagtgctttttcacctgaaggaattttaggagttttctgcactcaacattgtgcagctctaagaccatgacatgtgtttttttaatggatatataataattatgcaatttatggggaacatgtgatgtcttaatacatgcaaa

SEQ ID NO: 337685 - DNA, 1122 bp, Homo sapiens
ctgcccggcacatgggcttgtctccccacagtggggagggcctggtcagagttcagccctccatgccaggccctaggagaggggcttgtttggctagacctctcactccgagagacccagcagcctgaggcagccctgtctcatctggctctgtattgaccctccaggttgaagaggagaagaggaagaagaaagaggaggcggcccggaggaaacaggaacaagaagtaatgcattttgtttgggggtgagggctctactgggcaggagtgcaccctgaccccatgccctgtggctctctgtgcctccgtggaccttagccaggcccctgcagaccctcacagaaggagctccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337686 - DNA, 1077 bp, Homo sapiens
ccaccatctatcttgtacccggtggcccaaaaacagtttgcccagctgcctacctgatagctccactgggccaggaagcctctgatatctaggctgtccaaagtaaatgtgattttcaactccccaaacttgttcctccttcctgccatggagggcgtgcctacctgatagctccactgggctgggaagcatctgaaacctaggctgtccaaaggaaaggtgaaaatgtgattttcaactccccaaacttgctccttttccgtcagtggagggcatgtctgtttgtgcaatggctcaggccagaactccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337687 - DNA, 905 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337688 - DNA, 964 bp, Homo sapiens
cggcgtggggcgcgacttccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtaggtccaccgcggggtgtccctgcagcttctgcagttgcacgcagaagtcagagccattgggatccacagcagcgatcttaggtccacaaagatcttagatctgctacagagacctgagatttgaggaatcgagactgaatttcttctcttatttttaagatgaaaattttaattccataagtaatctatattcactgcagaaagactacagatcaccaaaaagaaaatgtccatagccccactgctaacatgctggactcgacctgggcactttttctcacataccttaaagttttctctcatccctcaagctctcgtggggtccccagatgctgagttcccatgacactcagacctgacaggcctgacgc

SEQ ID NO: 337689 - DNA, 525 bp, Homo sapiens
gaccacagatcagacgaaagcacggcccgggagccgccagcctcagcataggtaaggccccagcctggggagtgatgtccttgggctccttaggaaatagtccctcccagagctggcccctctgaaaccataaagacaagctgtttcacagcagcgtgtctgacctgaggaaagcagggcctgtcagcagctgggcagagcggcggcagacccacctgctgcagtagaaaggaagctcacttcatgctctctggcctgagagtctgtgtgactcgcacacctagcagggactgtgtgtcagggacgagagcgtccaggctctgggatgccggtcacagctgtagtgtgcacagcagcactgcccatgccagtccctgccctgtgtcgcggccactgagctattattctgttatgaatatgggagtgtgagcagctctcagtgaaccaaaactgttctttccgcagctcgaggccacagtcatgccctaccttcaggtgttatcagaattccgagaaggagtgcgg

SEQ ID NO: 337690 - DNA, 2329 bp, Homo sapiens
tagagtatccccgctgatcgcttagcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337691 - DNA, 3011 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagtaatgcattttgtttgggggtgagggctctactgggcaggagtgcaccctgaccccatgccctgtggctctctgtgcctccgtggaccttagccaggcccctgcagaccctcacagaaggagctccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337692 - DNA, 2571 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337693 - DNA, 2645 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaacactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337694 - DNA, 2214 bp, Homo sapiens
ccgcgggttaatcggcacaggaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337695 - DNA, 1712 bp, Homo sapiens
gcatcaccatccaggagatggtctggtgatccttgtagacagaaaggccatattctgtctcaaggggattgttctcctcatccttggtaggatagacagagctggagggaaaggagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337696 - DNA, 1282 bp, Homo sapiens
ccaggccggtgccctgcggggacgcccagcgcagcccagccccgctcagcccagccctgccctgccctgccctgccctgccctgcgcccggggcgcgcccaccgcgccgcatccatgttcgacacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337697 - DNA, 2550 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggctgatgggagcaagatgcgccagtcttcgtcccatcagggaagtgggcaccccgaggattagggtgagtccgaagtttgggagatttttaagataatatctgagaataggagtgggttcggtggagcaaaaggttcttttctattttcccacgtgttcagtgtaaagccagatgaggagacagattgagtttctggattactatagccataaggactttaaaaattgtttaagtcaatccccctaccttacatcagttttgtagatggggaaaccgaggcccggagtaacaggcaggattagccaatgccagatttttgacagtctaaacagttttctactacctcaccctccctggatatttcagtctcccattattaagaattccctttaggaggtcggtgcggcatggacattaggtagctaaacgtagatgtaggctcacagcgttttccgttagtgctacagctctgtccgggtaggtggagcttcgt

SEQ ID NO: 337698 - DNA, 2105 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaatggaggaggaagggtgacatggagaagaggggcagacagagcggctggccgatgcctgcacaccccactgggtgccctctgcagtgatgcccacatg

SEQ ID NO: 337699 - DNA, 805 bp, Homo sapiens
tacccctagcacttcctgtactcctttatatgctgagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337700 - DNA, 918 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggagaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337701 - DNA, 721 bp, Homo sapiens
cggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgaaacc

SEQ ID NO: 337702 - DNA, 320 bp, Homo sapiens
ttctggggcaaaggcaaattctaagaattcattcctggtaggtctttgtgttaaaatactctttaaaaagtggaaggccgggagcgatggaggccgaggcgggtggatggcaaggtcaggaggtcgagaccatcctggctaacacggcgaaacccagtctctactaaaaattcaaaaattagccaggtgtggtggcaggcgcctgtagtcccagctgctcgggaagctgaggcaggagaatggcgtgaacctgggaggcagagcttgcagtgagccaagattgtgccactgcactccagcctgggcgatagagccagact

SEQ ID NO: 337703 - DNA, 370 bp, Homo sapiens
agcaacaacaaagaaggaactactgatacatgtatcaatacggattaatctcaaaaatatcatgctaagggaaaactagacacaaagtatcggtatgcttctatttatttgaaattccagacaggcaaagctaacctaaagtaaaaaaaaaaaaaaaattgaacattggttgtgtcttcaagggatggggaaaggactgacaaggaaggagcatgtaactttttgaggtcatggttgttcgtgttcaataccttcataaggatttgggcaataaatagatgcatttggcaaaacttaaatggtatacttaagatttgtgcatttcaccgtatgtaaagtttactttaaaaactgtaaacagcctggaatt

SEQ ID NO: 337704 - DNA, 176 bp, Homo sapiens
tggttttccccactcacatgctcccagagcatttcatccatccatcaagctcagcaatgtcaaatcatgtatctctcaaaagtctagctgcctcttgaatggagggaatcctggagtaaaacgacagcttttccctctagttgtcttcttgatgcctagcaagatacctagtacag

SEQ ID NO: 337705 - DNA, 128 bp, Homo sapiens
tggatgaagttagtcaggaatggcaagcatagagagaggaggaagaaagaaaaggaagcccacagtgttcgctttggagacaccctttcttccccctgggaagggaactgggacacgaccctgggcag

SEQ ID NO: 337706 - DNA, 547 bp, Homo sapiens
tcattatttactcctcaggctctcacaaaagtcaccgcgtttgtgtaggtaactaaggcctaccgaaaccagtcagccctaagtgcacacaggagaaccatggagttggaggaaaaggatgatctgcaagtatcctgcaaatatctcacccagttattgctgggattccccaggaacattacatgggaacatatcgccatataggctcaatgggtgcagcaagaaataaaagatgagaattattaggatatgtgggatgctctggaagcattctagctgacgtaatagacatttgcggaaaagtcttggggatcctgaattcattaaacagcttcttcttttgccctggttcctcatgttttctagcagcaaaattactctgtccccttggtgccttggaatgctcccagcctaagctcagcccacatccagacaggccaatgctttggtagcaagctgaccacacaaactcttgtaaaccgtgataaagttcctagatattttggctattttagctttttattattgaagaaatacattaattttc

SEQ ID NO: 337707 - DNA, 358 bp, Homo sapiens
tcattatttactcctcaggctctcacaaaagtcaccgcgtttgtgtaggtaactaaggcctaccgaaaccagtcagccctaagtgcacacaggagaaccatggagttggaggaaaagagtatacaggaagcatggtgccagcatgtgccactgttgagggcctcaggaaacttacaatcatggtggaaggtgaaggggaagcaggtgtgtcacactgtgagtgtgacagcaagaaagagaggaaggaggtgccactcacttttaaacaaccagatctcgcatgaactcaggacttaggtatgtctttatcagcagacattagtccatataaaaacagactaatacagtaaattggtac

SEQ ID NO: 337708 - DNA, 369 bp, Homo sapiens
ggggaaatattttttattctgcatatcatagaatagtatgcattgatcataaaattttctgcagtagacttgagttaacttttcacctataaaattacaaccctcactcgtttccaacattagcatgaagaaaatggttactcccaggtttccacatcttactggagaaaaccgcaattaatgtcaccacaaatatccagtttccaacgttagctcagctgccattctgtgtgttcctgttcctcaatcatactcaattcacctgtggttcccgtcctgcctctcaccacagggtcggctgggcccaggatgacaaggggcctccctgcctcttccactgtcaccatcctctgcctcagggctgccatc

SEQ ID NO: 337709 - DNA, 271 bp, Homo sapiens
ctgtagtcccagctacttggtaggctgaggagagaggattgtttgagtccaggaattggaggctgcaataagctatgattgtgccatggtgctctagcctgggcaacagaacaagatgctgtctcttgaaaaaaaaaaaaaagaaaaagaaaagatgaatagtctgtctgaaatggccggcagtcgcagctgctgacctgacctgcatctactgtataagtcaagtagttcaactttttattataatgtcatggcttttctttgcttcttg

SEQ ID NO: 337710 - DNA, 90 bp, Homo sapiens
gggcatggaatccacacctagatactggatcttggtttgaatcctggttttgctattctactttctctgtgtctttaagcaagccactta

SEQ ID NO: 337711 - DNA, 304 bp, Homo sapiens
gcccagctaatttttgtatttttttgtagcgatggggtttcatcatgttgctcaggttgaatcacctaactttttatagacaggctccagaacttctccaggttctggaacctacatttgatttgagggtgagtggcctttgactcttgggagaaagttaatgatgcagaaatgcacttgggagaattgaaaacagaccggaggaacgtgtgtgtggaggctgcgcgtaccctgctatgatgggtgggacgtgctggagggcagcgtgggcggcgggagcacgggtggagggagcagctgctca

SEQ ID NO: 337712 - DNA, 130 bp, Homo sapiens
ctcccctccccacaacaaaatctgtacagccccagaccttttaaaattttgtttctgactcatgttgtgcgtaactttgttcaagagaaagctctagattttttttccctccatttcccaccagggccca

SEQ ID NO: 337713 - DNA, 379 bp, Homo sapiens
gccctccctagcagtggggtcttggagagagaagaaaggtggtttccccaggttaagagagacggcgtcaccctgggccactccagcctcatgctccctgcctggggaccaggtggtggctacaggtgtgcctcggtttcctcccctgggaagtagagcggccacgaggaccaagggtgatgtccgcggagcgtcccagcagagctgggatgctggaagcacctaggggcccactcacctcccgccagaaggcgcctctggtagagggcacttacctcactaggatggagccccagagagcccccgccccgctggaacctccacacctttctgagaggtaggcagggggcaggctgagggtggctcggcacccccccac

SEQ ID NO: 337714 - DNA, 121 bp, Homo sapiens
cacttgtatacactccctagctcctcatgcccacagggtaccaggtgacatttttgaaatgccaatcttacggtatcacctgaacagctctccatcacctaacagataaaaatcaaattct

SEQ ID NO: 337715 - DNA, 875 bp, Homo sapiens
aacccatacacttgattttttaaaaaatactgtcgtgtttttatgagtgtaggataaatccaactgctagtctatctaaaatggactatggtgatctgtggatagggtatagccacgtttctctccgctctctcaggtctttcctctacctctgtctccacctatttgtttcttttgctcattcacttactctaaatacgtcccttccattttctctctttctcaatgttaccttatattctaatgctctcactggtaaatgattaagaaacaaaagattaatcttaaatgattaagaaacaagagagaaccccaccttctggatttgcatcagggcattttgtcatgtagagcacaggcaagtatgcctttaggtcagtgactagtctgtgagcagcatgcggatgtggcttttggtcctgggtggcgttacatcagagcagctttaaactctctttgtcacgagcacatcagcagtacctgcaccccaggaccattcaaagtggccctgcgacttccagctgcaaggatctgtgtcagagagcacttttacttgagaactacacagagcctcactgcctccagcaggctagaagagccaggaaatgaatgcctcaagagctggcctcaactaatgactcctccagggttgggacaccaacacctcagctctctcaccctggggtcagataattcttcctttccttgagtcacttccctacctccctactggtgtttcctgcatctcccaaatgagctgcttgtactcaattccttgttctctaagaattcaggctagacactaatgatttagaaatgctaactgagaaattaaactgtaagtgatattttacagggggatgggcgcagtatgg

SEQ ID NO: 337716 - DNA, 341 bp, Homo sapiens
  misc_feature (311)..(311): n is a, c, g, or t
ctggtgagtgggcttagtaggtggttctcactctgatcttttccttgctcttgcagttcattacggggcaagaatcatctcaacacatccggcagttggtgctggctattggttgggacctcagatggggctgttagctagaacacacctacatgtagtagccttttatgactttgctccagaagtcacatagatagatagcatctgttctattctagtcacaggcctgtacagattcaagggaagagtgtcaacatcacactgtaagaagaatgtggtgtagaatgtcttgttggcagctgccgtcgacncggccgcgaatttagtagtagtagtcgacc

SEQ ID NO: 337717 - DNA, 496 bp, Homo sapiens
agtggtggagcgggtgagctgttgaggacatcttttgaaagtagagccaaaaggacttgctgattgaagagatgtgttgtatgagagaaggagaggcatctggaggctgaagtgattggaatcaagaatagcctcttaatttctgtctgaataacttatcaaagagtagtttcattaactgagttgaagatgagcagttaagggggaagcgacaccatgggctccattttgtacacttattgatctgcttctccatacaaggcactgtgttacacagaagtcataggtatctgttttaaagaacattaagcttttgtcaattgctaagtagaatcaatggtttcactgctgtctggatactactggactaaagtcaaaccaaaacaaaagcaaaaacaaaacagtccatgacagacagatattattagttgtcttcccaatacccagcctcctttcctccttattaaaaatctcttaccaggtgtggtggctcaca

SEQ ID NO: 337718 - DNA, 622 bp, Homo sapiens
acaaaaaaagttactcagcagcactaacaccacattaagactaggactttgcttcctaatgctaaggaggaggaccagtcaagaagaatcttggttaattagatcaatctaattctggcctgataccatgaaatacatacatgctctacggctgtggctcctacagtttgagacttgagagaatacattgcttatagttcaatgagagactgaaaaatgtgagtacccttactttaccacttaggaagttatctggatggtctcatgctagatttacaatcctataccctcaaatgcttgggaggttagattacatgggattaaactcagagggatgctggaagcacaccaaaatcttcactctccttcctgcccaatttggtccactataaataaaacttgacaggctttcttagttcaacttaataatgtgtagcacgagtgccttcagatgcccagtagctaaaccacacatcagctttcttaggaagccttctagcaacaggcagaaaaaagaacaactactgccaagagtgctgtgcacaagagtgctggtggcctcgagtgactcattcaacaaggctccatctttctgtactggaaggtcaaaagtgggagggag

SEQ ID NO: 337719 - DNA, 295 bp, Homo sapiens
tattactgtgaagagtaagatataacttgattcctattcttaaatatattttactcttaaaagaatatgaccatgtgattcaaaaaaaggttaagcctttgttttatgccagcctgtgctataggctctttcacctatgtctccctctctgccagtgaagaatctatatccccaaatctgatttttatacctctatgactttaatgttaccttcttcttatgaattttagcagatgcagtggttacgagaaaaactctggagttaacttcctgggctggaaacccaactcgatca

SEQ ID NO: 337720 - DNA, 632 bp, Homo sapiens
cccccgtggtgctgcaatgtgacgggcaccatgatgaactcttggttttaaaattcaactcctagctctgtctgctgaaagggcctagaaaggacaacacccagcagcagaggtgtattcttggtgcccaggtcgtggtttctacgtgctgttccccatcagccggaagcagggctcctcggagaaatggctgattccagaagtggggcaggaagtgaacacatgagccacagacagtgtgcagtgcccgagagtggcacagacatgaacgaatggcaagaggacccagaagccagcctggagggagtctttctggccatatctgggccaagtgaacatcaaaataaatgataacagtcatgaactctaacccctagaagccacactgacatgaaataaagagaaggccgagtggcaaatgctgaagaaatgatgagttgagaagcctccattttacaatcatcacagccaacactaatgcaggcaagaattccccaaagatgccaagtccactgggtctgcccccgaagatgccaagtccactgggtctgcccccgaagatgccaagaccactgagtctgcctgtggactgacaagatagtctcaaagcacctccccacaggtgagtcatt

SEQ ID NO: 337721 - DNA, 243 bp, Homo sapiens
atgttacactccatactgaacggagctctaacaagatgactcgctccacttcccagctccataccgtccactcgcattttccaagtgaagaatctgtatttaattaattgacacacacacattgggccccctggtaaagaaagaggttttaaatggctcagagacctggcaggatggtggagcctgtgagtcaggagtccttctccagacactcagggccccacccaggaggcaatcacaagg

SEQ ID NO: 337722 - DNA, 373 bp, Homo sapiens
tttgtttttttttatcttagtagcatagaaaatacaggccattaggagatggcgactgccccaagggtacggctgtccttttgtagaatgaagtgccaggcattgcccacatatgacctgccttactccgcctacccccaggggtgagacttctcagggctggccttgctccccaggccctgggagggaccacagaggggctcagcagtgacgagccaggcttccccacccgatccactggggaactcctgagaatctggccttaggcagacccttcctcacaagcccttccttgtttctttcagccggaaatccctgtttgctccactgaacttggggcactcctctgggtcactggtggcccttgggccct

SEQ ID NO: 337723 - DNA, 435 bp, Homo sapiens
tccaaagtttagggatctcttcacgtacttgtatttcattttgtctcctggtgcacgggtctttctcatgtaaaccgaccctcaagggaagcagcccctagcactggaactcacacccagcagcaattaaaccaattgcatcctccaaggtaaaaaacaaacaaacaagccaaaccaaagtggccagcgatttgagatcagtttaagcaagagctaatgttaaatgtgaagccttctattactggatataaaagtgaagaatactgacgaagcccgtttcgtattccttcacggccagattactattatttacttgaagacagcaaaaaggatgcttgcttaagacagaagccaggagtgtggatggagcctacaaaccagtcaattaaaatgggaggtggctgggcatggtggctcgcgcctgtaatcccagca

SEQ ID NO: 337724 - DNA, 474 bp, Homo sapiens
gtgctgggattttaggtatgagttcactgtgtccagctctgttagacattcgatttactactactcacctgagctgtatggaaacgctagcatctttaggtgaaaagaattatgtatattatcacctttctttgaactctccagtctgtatcttaaactgagaaatgatttgaaacctgtctgtatttttttttattcttttcctctttaaactttacagtgagggtattcaaacttaagtatgaaatacttcagacctaacataaatggaaggcattttattgcagtattaaagtgtggagtgaataacttaagtaggctttgtgcaaatcaatgacatttctgcatgctcttgtgtatattcctatctgtgcaattcagtgtgtgacactgtaagtaatcagaggagattttatgcactgaacgtgaaaatcagcctgaaagatttgtagccataccttgcattttttgaaa

SEQ ID NO: 337725 - DNA, 229 bp, Homo sapiens
tctgtaccccttagccacttagtttcatcatcatcatcaaacattttttgggttcctaaatatgtttcttcatgtttaatacttctttattctgcttgttctttcaagtagggaaaggacaaacttaattatttacaaaatgtagacgatggttaaaaaacaggaaaaaaatttaatgaagtgtaattcattctctctttttccttcttttgtactcaggttgtttatt

SEQ ID NO: 337726 - DNA, 212 bp, Homo sapiens
cagatgtcatggcgcttcctattcttggtgcttgaaaacttagtttagttgtgagatcaaggttatctaggccttctaggggtaagaaagaaaactcggaggagagaaaaaaaatctggcgagtcccgaacttgactgagggtcgggtagaagaagtcttgcgtattgaaggtcagtcagtgagtctagtagaaactcttagtcgactctgg

SEQ ID NO: 337727 - DNA, 142 bp, Homo sapiens
ggtcatttgagcccaggagattgagactagcctgggtaacatggtgagaacccgtctctacaaaagataaaaacattagctggatgtggtggcacgtgcctgaagtctcagctctctgagaggctgaggcgagaggattgtt

SEQ ID NO: 337728 - DNA, 395 bp, Homo sapiens
atctgccttctagtccatgtcttcaaacttggctaaacagagttcagtggcagccgggaggctgagtgatgatctcagggaaagaatcctcctatggccttatgtgttcaaatagcagctgtggctgggaggagcagcactgggatgaggagagaaatagctaaggaagtacggctgccatcggtttgggactgggcctgagttttcaccaaggtcacttcctaaaagccttcctgacaagagtgagggcagaagagcaaaaccaggagccactcccataggctgtcgtgagagtggagaagcagctatattagcaccatgtgcacccttgctttctctggcacactctccatctctgctcagattctaatccaagtgcgcatttaccttttctc

SEQ ID NO: 337729 - DNA, 555 bp, Homo sapiens
cctcccaagtagctaggactacatacgtccgccaccatgcccagctaattgttgtatttttagtagagacagggtttcaccgtgttggccaggctggtcttgaactccttacctaaggtgatccacctgccccagcttcccaaagtgctgggattacaggagtgagccatggcacctggcctagggttgttatatgtttgacatccgtcccatttgggaggccttctcatcagtcattttatgcctttaatgccattctaggtaggcaggaaaggggtcagggccagtgggcccatgtagcagatagggaaactgaggcccagagaggacaagccacttcttcaagaggacccaaactggatgccaggcaggccctctgcctctgggattttgcccatatggctcaactggcctaagtctgctggcccaaggaaaaatttcaacccaaccctgccctttcccccattcctctcgtgcaggggagttggcgggcctgcggcagcaaataatagctacgcaggagaaagccagtctagacaaggagctgatggccca

SEQ ID NO: 337730 - DNA, 710 bp, Homo sapiens
gagccaaagacatagcaatggagaacgtgggtggtacagccctccaccctggcgagcagcacattagaatcacgtaggagcttaaaaagtactgactggcctggtctttttcggtgtgaaggtgggatgcaggcttcctggggttatcctctcgtacagccagagttgagaaccatctgagtagcgcttgtcacacttctggccacatcagaatcgtctgagggacttgttcactgcaggttgctgggtcccatctctagcctctgatccagtagcctggggtggggcacaggatgtcctgctgctggggtctgggcagcgctatgagaactgctgacgttggagctcgatcaggtggtccctcactccctgacccagggcatttgctgcttcctgtctctgccattcttttctcaacctggggcacttgcttttctcgctatgctgccctgccctttgctgaggcctgggctatccctggcagggtgcagaaaaaaaatttttaagttacttttctcagcccaaaggagactggaatgcttcacaagggattctacttgacaggcaattggaccacccaaatggcaaactaaaagcatagaagcggacaccagaggctcctggacctgagatgtggccctggaagtgaccagatgtggtctcaagagatgggggcccagggctaggaatgccgccatccggggaggccc

SEQ ID NO: 337731 - DNA, 2031 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337732 - DNA, 325 bp, Homo sapiens
gcggccgcctactactactactactgctcgaattcaagcttataacgatgtacggcgacatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337733 - DNA, 1794 bp, Homo sapiens
gctcgctcttcgcccccgtctgcctcgatgacctagacgagaccatccagccatgccactcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337734 - DNA, 1925 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgtcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337735 - DNA, 1994 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctgagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337736 - DNA, 1860 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337737 - DNA, 1416 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagttta

SEQ ID NO: 337738 - DNA, 1245 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagttta

SEQ ID NO: 337739 - DNA, 1956 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 337740 - DNA, 1341 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagttta

SEQ ID NO: 337741 - DNA, 640 bp, Homo sapiens
tggctggccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagcagcccaggaggtcgacgcggccgcgaatttagtagtagtaggcggccgc

SEQ ID NO: 337742 - DNA, 170 bp, Homo sapiens
ccaaacgatgcccgatgtccaacgaacgaatgatctagcctcggcctacttctcaggacttagctttgtccctgcccgcgacttcccgctgggaacgtcgtccccgccaccaccggctctgcttaggttcgaactctgggccactcttcctactccctctggtttccagc

SEQ ID NO: 337743 - DNA, 264 bp, Homo sapiens
ctgaaagtctgattagaaaaatgttgtatcttctctatctattctctatttttttttttttgagacaacccaggctggagtgtagtgatgtgatcataactcaccgtggccttaacctcccaggctcagacaaccctctcacctcagcctcctgaatggctaggactacagtcatgcatgcaccaccatgcccagctaagttagtttgtttttctagaggcagggtctcactatgttgcccagacagatggggattctcccacc

SEQ ID NO: 337744 - DNA, 591 bp, Homo sapiens
gaagatggtaggcagtcacctacacaaatctctggggaactcatctgccacacacaggttcgcacctcctcattttgcacacatttctcacctcctcctcattcatccccctccgcaagtgagaatcactgcatataacaaaagatatttctcagagtggtttattacaaatgtagatgaggtgaaagcttaaaccaccaagtacttaaaattctcacaactgactacagcctcctgcgtagatgcttggtccttcctgagggatttctcattaatggaaaggatttcaaaagagaaaataaattattcctgtacataaaggagggtagataaaaagaaagggaggggagcaaaggaaagagagagggaagggctgtcaattttccatcagtggatgatttttcccaggagaattcacactgtttacaaatcaggatcatgttctttcaccctataatctgttccctcttagcagtcatcagagcaggcaccatcatctctctactgctccagctctcaactttcaatccatgcttgatgtctcttcttccctcaaacttcacttctactccatcagcaagtactcagatg

SEQ ID NO: 337745 - DNA, 507 bp, Homo sapiens
ctggggagcacattttgtttccatgcatgctaatgatttgagaatgccgcctggagatttgcactgactgtcttggaaaaatgtttatagtgtttcgggggtttcaaaactgacaggcagtttgtggacctgagtggtgtttaatcccccatttcccccacctgagtggtaaggggagaaacaacttggggtgcaaggagagcgctcctgtgctggagctcggccgatgctgggcagcaccaggaggattttgcgggcttcctcgtgaaagcaggaagactcagccaaggttagtccgtctgtcggtccctcaggcactttctcctggagataagaagggaagactccttttttctgagagatcttcctaatttgtttgttttgttgtagctgcctgtgtatggctgcgtctccccaggtacagcatgccgagtttggccacacagctatccaggtactaccatgtttccagtacaattctacattatccctctgctggtgtcgtgg

SEQ ID NO: 337746 - DNA, 3098 bp, Homo sapiens
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337747 - DNA, 3213 bp, Homo sapiens
  misc_feature (234)..(234): n is a, c, g, or t
  misc_feature (260)..(260): n is a, c, g, or t
  misc_feature (264)..(264): n is a, c, g, or t
  misc_feature (294)..(294): n is a, c, g, or t
cctgggcaataagagctactccagcctgggcaataagagctgttgcttcagagaagggttcctggcatagccaatgatgaggctcccaaacacagttccaatcccagcccctagaaacccaagctcctcctcggaaccgctgacctagagccagaccaacgttactcagggctcctcccagcttgtaggagctgaggtctcacccttaaccacaaggagcacaggtcccacctncagcccgggagcctaggaccactcancccntaggagtatatttccgcacttcagaattcnatatcttgcgatccaagctccgtgccccaaataacttcagtcctgctccagaatttggaaatcctagattcctctccttcgtatcccgagtctgggacacagaactccgcccccagtctatgagcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337748 - DNA, 3559 bp, Homo sapiens
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggagtgaggatccccctactagggcctgcagcctgtcctttcttcccctccatcagtttccaaccaccctcgtccaggactgaggcctggctcccacgccccatcccctttccatccagtccctaggcagcaaggccaccattacccaggaggtagggaccctgattaaggtgtcacatctttccctccctcccctctcctcctaattttttttttctcagaacagtctcaaatctccaatgtttaaccaccatcatccagcagtgggacttccaccctcggccccatgcccccctcctcattcttgctttcttcctctgggctgacccagacagcatcattttgcagtgaggaccccacctactcccccagcccctgggggctccatcccccgccaggtccctggggctacccccgatggtgagaccccttcagaccctacagagaccccactgctctcacagctacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337749 - DNA, 2495 bp, Homo sapiens
gccattgggctgggcttgaaagtctttggtgatgtgtagaagagtgtctgagaaagagaagggccctgagctcggagggcaggccccacccctgcagtctgccccaggcctcagccagcagtcctgtagacccagggaggagaccaggtagaagggctggcagcgagtggaggtgggagtggagatggagaggactccctgggatcttcctgtggccccttctgggtgtgccctggtggggcatttgtgccagcagggcagctggggctgcctccctgaggatcctctgcctcacctccatccagggcattgcctcagccaagacctactatcgggatgaacacatctacccctacatgtacctggctggctaccactgtcgcaaccgcaatgtgcgggaagccctgcaggcctgggcggacacggccactgtcatccaggagtgaggatccccctactagggcctgcagcctgtcctttcttcccctccatcagtttccaaccaccctcgtccaggactgaggcctggctcccacgccccatcccctttccatccagtccctaggcagcaaggccaccattacccaggaggtagggaccctgattaaggtgtcacatctttccctccctcccctctcctcctaattttttttttctcagaacagtctcaaatctccaatgtttaaccaccatcatccagcagtgggacttccaccctcggccccatgcccccctcctcattcttgctttcttcctctgggctgacccagacagcatcattttgcagtgaggaccccacctactcccccagcccctgggggctccatcccccgccaggtccctggggctacccccgatggtgagaccccttcagaccctacagagaccccactgctctcacagctacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337750 - DNA, 1078 bp, Homo sapiens
  misc_feature (912)..(912): n is a, c, g, or t
  misc_feature (925)..(925): n is a, c, g, or t
  misc_feature (947)..(947): n is a, c, g, or t
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctgggtgtnctgaagggtcatnatgcgctgtgaccgagaggagnggggtccaggggtgtgcaaaacctcatgaacgggaacgatcgttgagcttggatggcaaaatgtcggtgccataccggcttgacgcccggctggacgggattagagtggcccgggaacctacccaaggtgc

SEQ ID NO: 337751 - DNA, 380 bp, Homo sapiens
agggggtgtctccagccgtgagctggtgaagaaggtctccgatgtcatatggaacagcctcagccgctcctacttcaaggatcgggcccacatccagtccctcttcagcttcatcacagggagcccagtaggtgggaatcttatccatgacccacttcttcaaaaccctccatggtttacagaacccttttaagaactgtaagccttgtgaggttcggcaggtgttattttcctctttgcagttgggaaactgaagcccagagaggggaaatgatatgccaaagtcacacacggcatggcagggctggaagtgaagcctgatcacttggctccaaatcatcaacctcacctctgccccctcagcacccccacccttgcca

SEQ ID NO: 337752 - DNA, 466 bp, Homo sapiens
aatcagttcagtcagggctgtctgaggggtgtccagggttccccagcctgggagtggcaggggctgcatttgtcccctcagccctgccttttctgccactgcttactgtccttcctggagtataacagaggtcaaatgtggtaggagcactgaagagggggtgttcacttggtgggtgtaggtggggaggagggccattgggctgggcttgaaagtctttggtgatgtgtagaagagtgtctgagaaagagaagggccctgagctcggagggcaggccccacccctgcagtctgccccaggcctcagccagcagtcctgtagacccagggaggagaccaggtagaagggctggcagcgagtggaggtgggagtggagatggagaggactccctgggatcttcctgtggccccttctgggtgtgccctggtggggcatttgtgccagcagggcagctggggctgcct

SEQ ID NO: 337753 - DNA, 2888 bp, Homo sapiens
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337754 - DNA, 3138 bp, Homo sapiens
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337755 - DNA, 3145 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337756 - DNA, 3017 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagacaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337757 - DNA, 3442 bp, Homo sapiens
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggagtgaggatccccctactagggcctgcagcctgtcctttcttcccctccatcagtttccaaccaccctcgtccaggactgaggcctggctcccacgccccatcccctttccatccagtccctaggcagcaaggccaccattacccaggaggtagggaccctgattaaggtgtcacatctttccctccctcccctctcctcctaattttttttttctcagaacagtctcaaatctccaatgtttaaccaccatcatccagcagtgggacttccaccctcggccccatgcccccctcctcattcttgctttcttcctctgggctgacccagacagcatcattttgcactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttg

SEQ ID NO: 337758 - DNA, 1328 bp, Homo sapiens
  misc_feature (1162)..(1162): n is a, c, g, or t
  misc_feature (1175)..(1175): n is a, c, g, or t
  misc_feature (1197)..(1197): n is a, c, g, or t
caatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctgggtgtnctgaagggtcatnatgcgctgtgaccgagaggagnggggtccaggggtgtgcaaaacctcatgaacgggaacgatcgttgagcttggatggcaaaatgtcggtgccataccggcttgacgcccggctggacgggattagagtggcccgggaacctacccaaggtgc

SEQ ID NO: 337759 - DNA, 3919 bp, Homo sapiens
agctcagtgcccagcatgtctgtggtgagtgtgtagttcaggaagtgaactggcaaaactgagtatcaccctctcttcctgggttcttgccactcccctgaaaaccagggtagcattgtcacatcagatagctccgctacgtgtgcgctgaccatgctgagatgggcactgtggactcagcctctggtcattgctggaaccagcggcctccatgtgaggtacaggggaacgcactgctagcagatggttgggatgtggacactcgtcctgccctcttggcttggtgctgtgccatcgcacagtcattcgctgtttagcatgcatgggagagagtgaagcacaagggcccaggcccctgggagtgcctgccctcaatttggaagagcccttgggcacagcataggcgcctggcagaattggactgggccatgatccagggcattgggacctcacctaggagttggggttctggtcagaagccctgtggagacagggtctcccctgtgggcaccaaactgacctcaaactgctggttctttggccctggggacagggctggttgaagtactctcccggcagctgtcacctgcagggagaggtgggggtaggggtgctgtgtttcttagctgttcctcgttgcagtgttaaatccctgcaggttccttattctcagcttgtgttgtgagtttcagtgttgggggctaatgtgggtttgcgtttttggtcttggttttcccagtggccagtccatcagccactgcactgggggccaggtagaggccaactgcaccctgcctgccagagtagaaatactggtaggccccaggctctgctgccccttccatgtccttgtgtaagcatccatggacaaagctgactcacggggtgtgcacagctgcagggaggccaggaaacaggggttttattctagagggccttgtgctcagtgacagaccagagtcccatcactgagagagcagggctggggcagcacaaaggactggagagcatttgccatgatgccatgtgcacagccagtgcaagtccttcattgtagctgtggtcagaggtcatgagacactgccttcagcagccctgggagtccacctggtgtgtggttagagctgtgcatctgcagatttcagaaggacttacgtttggtgaggtgctttgaagtaacacttcacaaataccaagaagcaagaaatacacaaataagcaggtaatggttctttggtgtttacattagctagtgggcaacggttctttggtgttcacattagctatagtcccagaactcagtccatgaggtggaatcacaaaaatggaattcatttctggctgtcagtacacaaactgatttaagatatcaccttgaattttaagctgacaaacagtgatctaaactgaatttcactgattgccccacctgaaagtcagacctgatagataatgccctcccttaactcaaggccagcagcagatgtgttagaggggacccttgtgcctcgcagccctcatctcctaatggctgtggggtcactgtgtcgagttgtaatgcctaatgagctcctctaaaaacatcctgaaacttgtgtaaaaaaaacagcagactcccagtggaactcgccttcagatgcagcccagaataagagttctagaatgtgtgtgccatccttttgtctcaatctgcatgattgcaagtctcttcaacatgattgggtgcgtggagtgtctcggtcatgtgtcttcccctctgagcatgccttttgattcgcacctgtgtcacaattgtgccagcctgtgagatgtgtctgcctgtcaccagtatcggcacatttagttttccctttacgtgagttttggtaaaatagtgacaaaatgtaatgcagtgctcagtcacagaaaaatgtcaggcctacagaaatggagcatttggctggcgggtagcgtgatgaccataggctttatttggctggtgtggtaaacaagcagcagcttgtgcaggtgagaataaatggccatattgcatttcattttaaggactcccttaaaatgaaaatcttcgtgtgggacatgaacacaggctttcacgaaattgatcatctacactatatgtatgactgttgaaaggctgttgttcctcagaaattcttaaaatgttatgtaatgtacatgagtcccttcaggaagtcatcagctttgttcagtttcctcagattagatagtaaaactgagattatgaactataaagatgtgtgtaatttatctgtcagtgaacttgactttaataaaagctttttgaaaaagaactctgggtggggtgcattggctcacacacatagtcccaactactgtggaggtcagggcaggaggatcactggagcccaagagttcaagatcagcctgggcaggatagcgagaccctgtctatagaaaatattaaaaatcagctaggcatggtggcttgcccttgcattccctgccacttgggaggctgaggtgggaggttcgcttgagcccaggagctcaaggctgcaatgggctgtgatcgaaccactgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatgccaaagtatccctgagatctgcaagggaccgaggacagtactggctggtggtctgggtacaggccacagaggcatctggaccccatgtgcatctggaccagtttggttggatccattcatggacacaaaacggatgtgaactcacagagctacattttctccctgcccctgttcaggcacagtgaggtgtcggggaatgtagctgccagagttgactgtcccgttctttggtgtaatgcctgaaggccacctttaccattggtctgtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgaggcaggacgtgccagccaccctctgcccatatgtgcagcagggccacagatgtgcttgtcggtaggagagaccaagctgtctgtgtgccgatgtcttgacacctgagacttcaggttcacccatcctggttctgccattccattgcagggtggcttccctcctttggggactcttaacgctttggtctgttaaaaaaaaaaaaaaaaaatccgggcgtggtggctcactcctgtaatcccagcactttgggaggccgaggtgggctgatcatctgaggtcaggggttcgaggccagccctgaccaacatggtgaaaccccgtctctactaaaaat

SEQ ID NO: 337760 - DNA, 1757 bp, Homo sapiens
gggctagtacgaggctggtttagtgggaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatca

SEQ ID NO: 337761 - DNA, 689 bp, Homo sapiens
gcgcttaggcgtgtcgtacgtgtgcctctgtggtgtagcaagtagagcgctcaggcgtctcttctgtgtcttacggatgcgatggctagactcgctgcgcccgctgcttacggggatagcgtccttcaacgcctccgggctgatctctgtgagtcgaccgtgcatgaccatgagagcgtgtgactgagcgccgtatacactctgatggactgctgagccagcccagcgagctccgggatgctgtcctcctggtgttcgccaacaagcaggacctccccaacgccatgaatgcggccgagatcacagacacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337762 - DNA, 1067 bp, Homo sapiens
  misc_feature (833)..(833): n is a, c, g, or t
  misc_feature (845)..(845): n is a, c, g, or t
  misc_feature (851)..(851): n is a, c, g, or t
  misc_feature (861)..(862): n is a, c, g, or t
aaaaacaaatagctagtcagcctggtgtaaatcggacgaggagaaacaagcactggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccgggtttattatgtaatantttgttccatgngcagtncggtaccatnnaattattacttggtggtaagaaatcagcagtactcaaaggattagcagtacacgatacgacctgttgaagcgcacctgactaacagtgaccttgggtgttaccaccggctaagaactaaccggacagaacagaccataagagagtgcactcccagagagaaaaataacttctcttcctccttaccctcctctcccaaatcaagaa

SEQ ID NO: 337763 - DNA, 1891 bp, Homo sapiens
tccgccccttacccggcgtgccccgcgcccggaggcgctgacgtggccgccgtcagagccgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337764 - DNA, 1875 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattagccagtagaaaaagggggcgacttaaagtattcc

SEQ ID NO: 337765 - DNA, 1868 bp, Homo sapiens
ccacaccacacaacaccgatgatgcagagtgcgggccgggttcattcagtgcgagggcgacacgctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337766 - DNA, 2213 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattaaaaaagaaaaaaagaagaaaaaaaaaaaaaaagagaaaaaaaataaaagaaagaagaagacgaacaaaagaaagcagaacaacagaacgcgcggccgccgcggcgccgcgcgcgcgcggatccaggcacaagagcgtccattcaacagcaccctcatcaggtgcggagcaggcgagcgggggcccccgaatagcgacacggagaaatacccggttgagcagaacaacgggtgagttcacgcgcagagaaaccgcgcaagtgagaaggaagcagggggtagggaaggaggatcgacatcagcacacacagaaacgcaacgcagaggcggtcggtgggacagcgccacgacgcggcgtggcgccaaaaaaacag

SEQ ID NO: 337767 - DNA, 1887 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattcagacagtgaggaaatgctacggggtcagaggcatgtgtttttcgat

SEQ ID NO: 337768 - DNA, 1840 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcatcaactaggtctagatcattatcattttgtcctttcttt

SEQ ID NO: 337769 - DNA, 1952 bp, Homo sapiens
aggcggaccaacatcgacggacgcatcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaccccaacttcgacactcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337770 - DNA, 2476 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcaaaaaagaaaaaaagaagaaaaaaaaaaaaaaagggggggggggctaaaaaattttccccgggggggcccaaagttatatagcgcgcgtgtatccccaggtttttttgttgtctacaaaggggggctcccatatatataggaggaaggcgtcggatattatatataagcgcaaggagaaagggcgcggggaggttttaaaaaggtgtcggggagcgggggagaaaacgggagaagcgtggggagatctcttgtgggggagagagaggagccctatatatcttctgcggggaggggggggggaccatatatttggggagacaaattttactctataagagagaagattttaaagaggcttcaaagggggagaaatattataaaatttttaaaggggtggtatatgggtgtggtgtaaacccataagaggcgggaattatgtgggtgggagcggattggaagaaattttggggaataagcggagagttgtgtgaattatgtgaaacatcttttttattaccggggagcctttttttttattaaaaataaacaggggcgcagcggcgcaccaccgccacgcccgcgccgaacccgccacgccgcggcggccacgaaccagagcagagtgagcggccacagcgccggagccgccgagaaagacaccagacggacgaagcacaagaacacaaaacgcagaagagcaagacagtgcggagaagggacaacgaaggacacgagaacaacagaacaaaaccgcacaccacaacaaacaccaccccaagcacgacaacccagcc

SEQ ID NO: 337771 - DNA, 1814 bp, Homo sapiens
tgtagcatgcacttcgtgctcacacgcatgagctccggtgatgcctgacgtatttgtcaacccactgctaggagccatattgggctggagagaaacactgagcactcactcatcgtattatttatggactgctcgagggccaaaggaggatgatcaactagacttaaagacggtaaggtgtgattatcattatgagcgagtaccctaccatatgggttgaaccgctgcaaaagcgcgttgagtcctggacacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337772 - DNA, 1790 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgttgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337773 - DNA, 1604 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337774 - DNA, 1549 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337775 - DNA, 1076 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttcacagtgcaccacgacacagt

SEQ ID NO: 337776 - DNA, 978 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtgcaagaaatcactcctggtcaggtgaagggtttacgcccaggccctggccccagatccgtttggaaaacggcaccctggtatagtgtaacc

SEQ ID NO: 337777 - DNA, 1242 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatca

SEQ ID NO: 337778 - DNA, 1051 bp, Homo sapiens
  misc_feature (817)..(817): n is a, c, g, or t
  misc_feature (829)..(829): n is a, c, g, or t
  misc_feature (835)..(835): n is a, c, g, or t
  misc_feature (845)..(846): n is a, c, g, or t
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccgggtttattatgtaatantttgttccatgngcagtncggtaccatnnaattattacttggtggtaagaaatcagcagtactcaaaggattagcagtacacgatacgacctgttgaagcgcacctgactaacagtgaccttgggtgttaccaccggctaagaactaaccggacagaacagaccataagagagtgcactcccagagagaaaaataacttctcttcctccttaccctcctctcccaaatcaagaa

SEQ ID NO: 337779 - DNA, 855 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337780 - DNA, 535 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcagacctccccaacgccatgaatgcctccgtcgaagttgcggatcctctaagtagc

SEQ ID NO: 337781 - DNA, 688 bp, Homo sapiens
ggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattttcaccggctctccagtgcttccacacagg

SEQ ID NO: 337782 - DNA, 1842 bp, Homo sapiens
gggctagtacgaggctggtttagtgggaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337783 - DNA, 1029 bp, Homo sapiens
tccgccccttacccggcgtgccccgcgcccggaggcgctgacgtggccgccgtcagagccgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtgcaagaaatcactcctggtcaggtgaagggtttacgcccaggccctggccccagatccgtttggaaaacggcaccctggtatagtgtaacc

SEQ ID NO: 337784 - DNA, 636 bp, Homo sapiens
agtggctgtgacggtgagtgccacacagagctgcccacactggtggagggaaggcagggagataccaggaccatccggaaggggctgagtgtcatttgacaggtgccatgtgagcagagatgtgaaggagtggcccgggacaatcagggcagaatccctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcagacctccccaacgccatgaatgcctccgtcgaagttgcggatcctctaagtagc

SEQ ID NO: 337785 - DNA, 1840 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337786 - DNA, 1896 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattaaaaaaaaaaggggggcggccaaaaaaccccgggccattcggtccctttgtcaagg

SEQ ID NO: 337787 - DNA, 1755 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatca

SEQ ID NO: 337788 - DNA, 1801 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaaaaaaaaaagggggggtctaaaattcctcaggggccataataccct

SEQ ID NO: 337789 - DNA, 1955 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaccgcaaacacacaccaaggaccgcggaggccgtaatatgccggatgcgcacaaccagcgctccacgaaatgggcaccgtgcgcctacgcgggcaccgaacacagcttcctggcacaacacgggagaaacagcggagaccccataaagggggcgccataaacccgaaaacagcaggtaccggcgtagacagggcgacaaca

SEQ ID NO: 337790 - DNA, 1785 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337791 - DNA, 1580 bp, Homo sapiens
  misc_feature (1553)..(1553): n is a, c, g, or t
  misc_feature (1557)..(1557): n is a, c, g, or t
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagctaagngagntgggatcctctagatcaaaccca

SEQ ID NO: 337792 - DNA, 1987 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaagggccggatcttgtcctgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337793 - DNA, 1975 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccagacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337794 - DNA, 1774 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337795 - DNA, 1149 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 337796 - DNA, 1095 bp, Homo sapiens
  misc_feature (892)..(892): n is a, c, g, or t
  misc_feature (925)..(925): n is a, c, g, or t
  misc_feature (929)..(929): n is a, c, g, or t
  misc_feature (933)..(933): n is a, c, g, or t
  misc_feature (935)..(935): n is a, c, g, or t
  misc_feature (938)..(938): n is a, c, g, or t
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtatggnaaagagaatacatcctgtccgcgtaaggggttngccntggncnggnccgggtgcggttggggagccgcgcccctgttttgcggttgcaccttgggggcgtgccccccccggcctttcattccctcgcgctgtgccggggcgcccattttgcgtggcctcccctcccttggggggccgctggtcacctctcctcgtttccggcc

SEQ ID NO: 337797 - DNA, 685 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacttcgcgaatgggtactagctcgagtcgtatatga

SEQ ID NO: 337798 - DNA, 889 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacactgtaattatagctattagaataaaatctcttaactattaaaaaaaaaaaaaaacaacatgccccacaccaagaacacaaagaaaaacaaggacgaagacaccccaagaaccccgagcacccacaacagcgaacacccaagctacgaagacatctaagcacggagcacgatctgacaggaactacctagacgatcgccaacaagagccaatcagaggaccacatgtcgtcacaacacggcaggggtcgcaaacacaacgcaccgccgaccaggacggcagttcatcgcacaagcgcagagacaatgagcagaacacacgagacggccgacagcacgacccccgccagcgcgccactacccagacagt

SEQ ID NO: 337799 - DNA, 516 bp, Homo sapiens
aggcctgcgaggcgaattcgacacgaggaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggccattcaacgcctccggccattcaacgcctccg

SEQ ID NO: 337800 - DNA, 376 bp, Homo sapiens
cactccccctccagcacttttcctcatgggagccagccctttccatagcctcaagtggaactaatctgtcacttctttctcttaccttctattcccgacaacagacatgtgtgcttggtgacttagattcatatctatagtattaatagacacctttaggatatgcatgttagaaacatgaatgttgtgttaagtttcctgtcttagaacccagaacttggcattgtagaatccatctgtgcagatcaatcatatcaaactgggatgtcactgagtttttagaggtttgtgaactttacaagagtcgctttgaaaggagctttgaaagcatgaagaatgtttgttagaagagccttaaaaaatgtaataaccggcc

SEQ ID NO: 337801 - DNA, 423 bp, Homo sapiens
ttttttgagacaggtttgcactctgttgcctggattggagtgcagtggcacaatcttggttcatcgcagcctcaacctcccaggctcaagtgattctctggcatcagccccctgagtatctgggactacaggcgtgtgacctcacacttggctaattttttttattttttgtagtgatgggggtcttactatgttccccaggctggtcttgtactcctggcctcacgtgatcctcttacctcagccttctaaagtgctaggattgcaggcgtgagctacaatgcctggcctacacacagagccctctttacgtgaaacaccacatgagactacaggcccaggatcccactgggagaagtgctgagataatctggaagatgggctgtcagagaagagagagatgcgcaccagtctctaccagat

SEQ ID NO: 337802 - DNA, 404 bp, Homo sapiens
ggccactgcacccagcctcacatagatgtttaatatcttttgttaagtttaaccctgagtatcgcgactgttgttgtaagcggggtcttctcttttcccataccttctagtgacttgttatttatatttaagtgtgtgtgtttatactaccatctttagtttttactttttcaattatttatcttgacttttccaggtatacaataatatcatatgaaaatagcaatagttttaactatttctattgcgttttctttcttttgtcaaattcctctgataaatacacccagtatagtgatggtggtggcagcatctgtgtcttccctgagcttagtattagtgcccaggtatgaaactgtgtattcgtactctctggagtatgaagctggttcctggcttctgtg

SEQ ID NO: 337803 - DNA, 214 bp, Homo sapiens
ggaacttatgttctccatcatctctcatctggactcctctctctgccacttcattagtgtccccctccatattactctccacaatagtctgggtaaggcaaatctgaaaatcttctccaacttaaaatccttcaatggcttcctattactctcagaataaactccaaagtctctactaaaaatacaaaattggccaggcgcggtggctcacacc

SEQ ID NO: 337804 - DNA, 350 bp, Homo sapiens
actgccagtaggttaggaatccctggaatcagccttcattcagtgtatgacttaagctcctgggtctgaatttctcccatctataaaatgagaataatgcggcttgccctgtctattgccctaggactgctgtgagtttcccaagacaggtgggaaagggcttggcaggtgaggaactgtcattacaattgcctgaggagcctaaacatctcctgagcaaagggcccacggagctgctgcccaatcccaggccctccatggactctgcatgccagaagctgaggatttctggcctggggcagaaatgaggggtctcatcctgtccaaggactaagttcgggaagattcat

SEQ ID NO: 337805 - DNA, 343 bp, Homo sapiens
atccaggaaacactcttatgggaagcttctctgtttttgttttggagcaactttgcacaattaatcacagcatcatttacagttataaaaagttggaaacaacctagaggcccaataagtagaaaatagatcatttatagtacacaaacttgacaatatattatacaatattaaaaacaacaatggcactaacataacaacattaagaagtacttatgttatatgtgggaaaaatgatgctgtattttgttatgaaaaatgcaaatggatatgttagtgccttcaaaagggcaagaggattatgaatgattaagcgtacttatttcctttattgtttttctta

SEQ ID NO: 337806 - DNA, 508 bp, Homo sapiens
gcggccgcctgaggggagcccgcgcctccgccgcctgagaggaggtcgagctgccgccggggcgatgctggaggagctggagtgcggggcgcccggcgccaggggagccgccacaggtcggttcgggcccgcgccgaggggaagagggggcgcggcgcgcggcctggacgggccgaggcggcgatgggaggcggacgggcctccgggcgccaagcctggtcctgcgggccgggcgttcaccccctggggccttctcatccccagcgagggcctggcgtccccaagggcacccttgttgacgttattgttgtagccgcgaccatattgtttgtttccggcgcttttgcgtcagttcgtccctccaggactctctggggcggtgggtcggaggggccgagaggggaaactgaggcccagggaagcgaaagggcttgccctgcaggttactggatgcgtttgtgtcccttgaccatgttggaccttgcagcgggtggggaaactgaggccc

SEQ ID NO: 337807 - DNA, 3525 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaagccaaagcaaagagtcggctgaaatgtcatttgctgtctcacagggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337808 - DNA, 3356 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaacagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337809 - DNA, 2719 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337810 - DNA, 3429 bp, Homo sapiens
gcggccgcctgaggggagcccgcgcctccgccgcctgagaggaggtcgagctgccgccggggcgatgctggaggagctggagtgcggggcgcccggcgccaggggagccgccacagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337811 - DNA, 1362 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggagctaaacttgaggaaaaaaggaaaaggatggtcatggatccagagatctcc

SEQ ID NO: 337812 - DNA, 2355 bp, Homo sapiens
cctgaaatgaagatgtggttctgatgaggaagaagaaaagaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337813 - DNA, 2004 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaagccaaagcaaagagtcggctgaaatgtcatttgctgtctcacagggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccaagcgggccaaggaggaggccaagaagaagaaggaggaagagaaggagcttaaggaaaaggagaggcgggagaagcgggagaaggatgagaaggagaacgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcc

SEQ ID NO: 337814 - DNA, 571 bp, Homo sapiens
agggaaggctgcactgaggcagcaagggagggccaggtggatttctggagcactcgccaaagaggaagtacagaggccctgcagcaggctgcgtgggaggagtgtgcccgggtggtggggggcaggcagggtcaacctgagagcaggtgagcaggtcacctctagaagaggcacaacgccccagcctctgcctgtccccactgtcaggtggagggtcccgccctggggttgttgcaggccccatgaggcagcagggtggggtcttcccccagggagcccagagggcccagccagctcaagaccctccctctcttgccctgcagaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggatta

SEQ ID NO: 337815 - DNA, 3480 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337816 - DNA, 3164 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcc

SEQ ID NO: 337817 - DNA, 2939 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaaccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcc

SEQ ID NO: 337818 - DNA, 3045 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagagttctatataggatgctggattagttcctttgatatttgtaaaaattcccccaagagccgcatatgaatctgccctttaataaagcattattgagattgctggcc

SEQ ID NO: 337819 - DNA, 3505 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagagatggctttctgtctttgtttcagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337820 - DNA, 2559 bp, Homo sapiens
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatctttcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaacagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgaaaaaaaacatcaacacgcaatacacaacataagcaaaacaacgaactaaaaaaccggggcgcatattagagggcggcgaaaaaagagttaataacggccacgcgacataagttccggcacacgtttttcaacaagggaaacagggcccccaaagggggcaatatagaggtatt

SEQ ID NO: 337821 - DNA, 1178 bp, Homo sapiens
  misc_feature (1123)..(1123): n is a, c, g, or t
gcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaaagaaattcgtcaaaggtctacagagaaagaaccaagttagactggcaagagatcaggagcgtctgggcagcagttcagttacgtgacgaanggagacaaggggagtttaatatgatgcaggggcagggggcccaaaaaagggccag

SEQ ID NO: 337822 - DNA, 301 bp, Homo sapiens
ggctaaacttgaggaaaaaaggaaaaaggaagaagagaaacggttaagagaagaagagaaggtagagtgtttcccacagagcttccccgtcccagcccgttggagaagcagatgcccaaagtggaattcttgccacagccgtcacctaatattctcttggtttggggaaaccaaatggcgcccgcagggagggcgagtctgtctagatgcgttcttgttgcttcttcccagtgctggctgtcacatgcctactggccctgcaatcctggcacttctacccacaagggcaacttggacattt

SEQ ID NO: 337823 - DNA, 384 bp, Homo sapiens
ttctttagtctgaaccttcctttccagtcgaaggttttcccttgtgggagattttagttaaaaggttggttaaagggagagaggctcctgaactggaacagagtgattattcttaatatctacaagtttattttaacaaaagactcttgcaaattctactccaagtgaatgagacctgtcccaggcaccattttaaccagaccaagattccaccaccaaaacaaaaaacatattattaaggcagcacaaccgctcctaattcctagagcaaaagttctaaccaacaggagcaggagggtatgagaacaacaaaactggtaatcctgtaaaaccaataaagattgtatttgtttagagaggtgttttatcaatgcagaatctggg

SEQ ID NO: 337824 - DNA, 727 bp, Homo sapiens
tgacctgtgggttcattacctgtgtcaaagactgaagacgggagaattagggaagtggtggcctgggagaaccaaggacatgtttgtgtgccctatttaggcgattgttctacttcatgctaaatttgtgaggagttttatgaagcctagaaaattaagtagaaaatatatttttacagtattttaagctggaacagactatttaaagctcgaagagaccctagagataaaccagttcagtctcttccttttgcagtagaagggacgaggcccagaggactcacggtgtttcgggaacttgcagggagttagcgcagcaccaggatcggagcgcggggccccgtgtccagctccttactctttttgttctggcagcgatgcccaccgggccttcacagtacatttctctggatacagagagaaacattattcatctgaaagcaaggcttcagaagctgtttttataataatttgttagagccacatagtaacttgcaaataaacatttacagttaatgagaaaaatggatacccctgagaaaaaccgtttgtagttactgtgttctagtcagagctcttgagctaatttgaaaggaaagtcaggattctggcaggaggagagctatccccagattccaaggatggggaagagaatctctgtatggactagaattcgagactgtcctgtgtccctctgtctctccttcccggtcttctgtctgtgtcc

SEQ ID NO: 337825 - DNA, 402 bp, Homo sapiens
taaggagtagtgtaattcttgcaactaatgggaaagaagtagagacagcagcaaagccacctgcttctggaagggagagtgcaagcattttctccaggacaccaggatagggaaagcaaaacttccaaacaaagctagtttcaggcaatgaagacactatgtaaagcttccttctgggttatcccaaaagaattctaacaacataagattggaggttgtgactgtcttactccattttctgctgctattaacagaataccacagactaattttttttttttttttttttttttttgggaacaggtttttgctttgtcccccgggggggggtggcggggggcaacccggggtcacgtgagccttgtgccatgtgcttcaaacaagggggggacccctctaaaa

SEQ ID NO: 337826 - DNA, 369 bp, Homo sapiens
taaggagtagtgtaattcttgcaactaatgggaaagaagtagagacagcagcaaagccacctgcttctggaagggagagtgcaagcattttctccaggacaccaggatagggaaagcaaaacttccaaacaaagctagtttcaggcaatgaagacactatgtaaagcttccttctgggttatcccaaaagaattctaacaacataagattggaggttgtgactgtcttactccattttctgctgctattaacagaataccacagactaatttttttttttttttttttttttgagacagagtcttgctctgtcacccaggctggagtgcagcggcgcaatcttggctcactgtagcctctgcccactgg

SEQ ID NO: 337827 - DNA, 332 bp, Homo sapiens
cactctgggaaggccccagaggaggctgcacctgaggggggccttaaaacactccagaggggccttgaaacgtactagaacttgtctctgaggcagagagaggccaggaaaggtacaacctccacacctccctgccttctagattatcttatggaaatcagacaccaaaagggttcccctctcaaaagcgagaatctacaagaaggactttgccagtggctcccacactgtgagagtgtgggtccccgttccccagccctgcccgcccagtcctggtgtgccccattgccctggccgccgagtcctggtgtgccccattgccccggccgctc

SEQ ID NO: 337828 - DNA, 3222 bp, Homo sapiens
  misc_feature (2084)..(2084): n is a, c, g, or t
aaagtggaaccggggcggcgcgggggccggcggctgccgcgatctctccctggtagcgggaggctgagcgggcggcgcgacgcgggggccgacgggggcgccgggtggccgcgccggaagtgccttgcgcggcagaggaagcgcagggacagagcggagcaggccgagccggcggaaagggtctttgctgctgcgcccgggcaggggctgccgcggccccaggtcccgcttcgagacgcggcgcggtccaggcgggaggcgactccctaggaagggacccggggcgggaggaggaagtgaggccgcgcggaaggaaggcggcgagccccggggccccgaggccttggccgcgtcacagcacccacatggcctctggagtgggcgcggccttcgaggaactgcctcacgacggcacgtgtgacgagtgcgagcccgacgaggctccgggggccgaggaagtgtgccgagaatgcggcttctgctactgccgccgccatgccgaggcgcacaggcagaagttcctcagtcaccatctggccgaatacgtccacggctcccaggcctggaccccgccagctgacggagagggggcggggaaggaagaagcggaggtcaaggtggagcaggagagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagaagcaaagactcaggtggactgaaggccgctatgatcgaattggtggaaaggttgaagttcaagagctcagaccctaaagtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttaggggnaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgtt

SEQ ID NO: 337829 - DNA, 194 bp, Homo sapiens
caggtggactgaaggccgctatgatcgaattggtggaaaggttgaagttcaagagctcagaccctaaagtaagtattgtttggaattgattgggtgttggtaccccaagcatttcattctccttgagctaaaattgtgaggtgttgatgatcatctctctgaatattgcattaagatttaattaagcctgccca

SEQ ID NO: 337830 - DNA, 2599 bp, Homo sapiens
  misc_feature (1461)..(1461): n is a, c, g, or t
agttaaaaaagagcaaataaccagagttagtagaagaataaaataaagagcagaaacgaaatagaaaacagaaaatgaagtagaagtctattctctgaaaacatcaatccaatacgtaaatggctagcaggattgcttagggaagaaaggagagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagaagcaaagactcaggtggactgaaggccgctatgatcgaattggtggaaaggttgaagttcaagagctcagaccctaaagtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttaggggnaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgtt

SEQ ID NO: 337831 - DNA, 448 bp, Homo sapiens
tcttgaggcaatcgttttctgaaataatcttaagttgactccattgctcaactatctgattaagtagctttatattcttaaaacaaatatttcatttgtttttaaattttattcttccaaatataggagcacccaggattaggcaagatatttaaagtagacataaaattactatgtttcctcatatgctaagaaaacagaaaacgttggtgtacatacaaaaaagatatttgatcgcctttttttcttcttaaaatacgtttatgaggtatcagttgaatgagaacaaaatggtagcagtgggtgggaagctggaaaatgacctaaattctaggatacgaatccaatgcattgtagataaatatgttagctgtggcaccataacccgctggatccatcaaccatgtggatccatgatggggacaagtgaatacaaaaggtaaaaatg

SEQ ID NO: 337832 - DNA, 565 bp, Homo sapiens
cctccaaagtagttggaactataggtacactcagatcatttaagaactttcaaatcaacatatgaataagaaaaacagagtggtgtaaaatattgctgaggaaatgcaaaataaagtcagaggtagtattaagtaaagttacttatgtgtgtcaaggaagagttctggtcttaaaagcagcaatggactcagaatgaaaaaggtgaacaaacgatacgggaaagatacagaggttatgaacaatggtaggaacactggaatagccaaccaaggtaaaaaaggctagaagttggaagtagacattagaagactactgtaaagctttggatgatgtataatattataaagctgtagatttctgcagcagaatataaaaatcagcacaattttttttttctggcagttaaacgagtgcaaaattcataaaaagtgaggccacagctattaggacttaatgcctagacagagtggtagccgtgatagttagaaagaggtgaactagtaatgtggtaatggctaaattgggcaaagggcaaggaaaaggaacaagaacaaaaagagaatc

SEQ ID NO: 337833 - DNA, 525 bp, Homo sapiens
tcaagtaatccatagtgttacaaagtacctgcctgttcatctgtttccctttgatccagtttctagttttcctttccacgtttggcctaatgtatattaaaacagcttcagtttgtttaagggaatggttatgcatgctggcaaaataccaggttacgtgcagataccttctgctaaactcagtctgcatgctgcccttcccaaagccttaatcatgtttaaattgaatagcactcaggtgtttagaagttgggatttttttcatgtaaattgtacttataaaaactgaatctgagctgctattacccactgatagttattttttctacatgtcgatgtctggattctataaccatttgtttttccccagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgaca

SEQ ID NO: 337834 - DNA, 385 bp, Homo sapiens
ggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgaca

SEQ ID NO: 337835 - DNA, 450 bp, Homo sapiens
ggtgaggaggagctggagaagcttgggaatgggaagaagctgaagaagctcagtggtgaagaggagctggagaagccctgagtgagcccgagctgggagtggtgagtgtgagtggaccttcccagatagatctggtgagaatggggtggcagttctagaactgaacaagaggggcttcctggtcgtggaccccgacgggtgggcatgcggtagatacccagcacatccgagggaaggatggatggctattgatttcccttcaggccatgccaatatgtttgtcaagcaacagatgcaattcaagtgctactgtgatccaggtgtggctcgctgtttaggtaaagaagcttcacaaaggcgctgccacaaaccaacatgtgttctttgggtttcatctcgtaatttcattcatgaaggttgggaattctgttactcagaatcttacctatt

SEQ ID NO: 337836 - DNA, 225 bp, Homo sapiens
tcccagtgagataattgaggtctggggaaaaaaagagccagaaatccctgacggttcttgtgttctgattcctgctggagggggtaaagtgtgagaggggtatggtggtcttggtctttagttctaagagacagagaggaatagggacagcagtgaggggtgggggaaaggggatacttgtctaagtgctcagaatgtacaaagcaagtttgaagagaggtccct

SEQ ID NO: 337837 - DNA, 302 bp, Homo sapiens
gttggtgtgcaggtgttggtgtgggtgttggtgtggatgttggtgtgcaggtgttggtgtgggtgttggtgtgcaggtgctggtgtgggtgttggtgtgggtgttggtgtgcaggtgctggtgtggatgttggtgtgggtgttggtgtgcacgtattggtgtgcaggtgttggtgtggatgttggtgtggacattggtgtgcaggtgttggtgtgggtgttggtgtggacgttggcgtgcaggtgttggtgtgggtgttggtgtgcaggtgttggtgtggacattggtgtgcaggtgctggt

SEQ ID NO: 337838 - DNA, 301 bp, Homo sapiens
gggtctgtaagcttcactggaaccttttccttggggacgtagagaaagtccttttttctaccttctaggagtgagtggctgcagaaaggggaactcttcacgattaaaaagaaaatgtgataaagtctcatcaacgtgcataggaatttgctcctcaggctggttcacagggatgcctatgaagcatttctgagaagtggatgtacttcatgaaagatgcgatgcatcagctaccctacaagattttgcagttgggaaagtaatgatctaggattcatagttctggaggactaaggcagtt

SEQ ID NO: 337839 - DNA, 241 bp, Homo sapiens
tatgatgccatttcaaagacggaacacactgaggttaagtaactggtggaggatcagaagccggtatgtgtcagagcgaagactccaacccaagtagattccatacctttaaccactacctcatacaatgtgtgtgtgtgtgtgtgtgtgtgtgtgtgtgcgcgcgcgcgtgtgtctgtctctctctcttagacagggtcttgctttgttgcccagggtggagtgctggagtgcaatggca

SEQ ID NO: 337840 - DNA, 338 bp, Homo sapiens
taagcacctgcctcttggttttgttgtacagatgacatatgagaacccaggcctggtgtggtacctcgcacacagtaaaggctgagtacaggcagctgtgtctcctgctgtcattcctgaggggctccctggccctctgccccccggggggattctcattaggtcacttcttaaagcctcctgagacaaggcattcagtgcccatcctccctgctcactatgcttggcacccacttcccccagtgtgctcaccaccatgtggggaaacagtcaattccatggtgctgtgtctgtcttcccaggtgtggcccctctgccgccccaaccagctcacctcg

SEQ ID NO: 337841 - DNA, 847 bp, Homo sapiens
cctgagagacgcttacacctcagtagtacaagcgctcgtatcttgttggagtatcagattaaaacagcaggctgtattccattacagaagataccctcacatccaaactgcttcatacgagaaaggctaccagtggtccatgagttctcatcatttagtagattaggattccagcataaaaagaaaaactgacaaataccccttttaaataagacagagtacattggactgtgtatatgttgtaaacgaattctaaaagccttttgactaaaaatgtagttattcaaagtttgttatactagaatttaattcatagatggtcctagtctctttgctttcgttttaaatagcacttgcatcttaataggatgaaaagtacgtgtctacctttctctgcccttcactatgctggagggaccttgctggcaaaagactgtgcaggccacattttgagtgtccagctcctcccacctagggcacagctctaccaagggcatggcatctgttgcacctccagcagcctcagccccactgttggttgtgtattcatggtactgtttgggggtggcatttgggcctgaagttggggtatcctgtgaggtagggatacaggtctagttgctgtgcaagagacccaaaacaatagccgtgcaagtgcccctgcccagcacaggaggcggctgccccattacaggcccacacttctgactggctgcatccccaaggaggaaggggcatggatcattccttcaggacaccactcacaaggcgcccacctgacttccaatcatatcttcttacagaaagaggagaacggatgtggaggtgcagtgtgtactctgaggtg

SEQ ID NO: 337842 - DNA, 331 bp, Homo sapiens
ctttgtttataaacttttccatatatctttctttagtatctccttttctaaattatagtcctagcccttttcttttaggaggcttttcatttgcccaatttcctattctatcatcaaagttctgaattatgtctcttgcttattagccctttatttattatctttatccctaagtccttactagagagtaagtgttacagaaataggtactctattttttaatgctgctacatttacagcacaattctattttttgctaattgaaagccagattctttgcttacgatgttaaaaccatagcttcatagctaagaccagacctagggaatct

SEQ ID NO: 337843 - DNA, 316 bp, Homo sapiens
cacggacagatatcagcccctagatgagccggctggttttattccctcatcaagtcctccccgaccctggacctcaggcactgttttgtatccggctataaaggaagttgggtgactgctttcaatgtactgtacacatcagcagtcagtgagaagtcaccaccataaccatcacacatggtctgggtgagctgagccaccaccaccactaattccagcaacctgaaaggaaaagcaggatgcctgccaagcgtgcccagcaaggggaccctgggagaccccatccgacctcctccatccgtgggccaggtaacaa

SEQ ID NO: 337844 - DNA, 370 bp, Homo sapiens
aattcagaattttattttagaaaggtaatagaaaacatatgctacttattatgaatcactcctagcaggatctgggaagattcttagaacctataatattaaacatttctgtagcaaacatgattatttgctctaagtggaataagtaaagatttttaatagcgtcacgtcacttcaagttatgacactaaatgcattttggagcgaaacttacaaaaaacaatatttttaaaactttctggattttagacttgtgagtaaagattagattttatataaatcgcattgtgagttagggagtgcttaatggactggccttggaagccagtcagtatttatggaaaaaaaagtgtgtttcgaacgaccaata

SEQ ID NO: 337845 - DNA, 279 bp, Homo sapiens
ctcagcctcccaaagtgctgggcgtacaggcatgagccaccacgcccagccctacatttctttttaaacaaaacaagatttgtggttacatatggttatctatctgtctagatagataatctatctgtcatttattgccttcaaaatgaaattaattttcaaggttttttggaaatggctactaatgatgtagttagatgcccagtgggttataccaagattctttcctgagtcactatttgtcattcctttttcccaacccttgtaagtattaactgt

SEQ ID NO: 337846 - DNA, 730 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 337847 - DNA, 866 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaaagttgggtttctatttttcttatcctactttttgctgcaaaccaacaatcactagtgagacttgtattatattgagattattgcaagcttcagtaagttcatcttgttttggactagagaatttgccaatcctgat

SEQ ID NO: 337848 - DNA, 1001 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaaaaaaaaaaaaaaaaaaaaaaaaaaaagaaaaaaaaaaaaaaaaaaaaaaaaaaaaaaaaagggggggggccccccaaaagatccccccccgagggggcgcccacacgattcagacggcgcgccgccaagatattggtggaaaagagggggcgcgcccaaataagggggagcggtctattaaaacagagagcgagcggcgggcggcaagagtataacacaacgagcagacagcggtggaaaaacacggagaacagcgggggaagcacacatggaggagaggagcgcaccccactaaactcgcgccggggggggggggggagaccaacacaaaagaggggacgaggaacaacaacaccagctagccacgagagaagagattaaaagaacggcgcttgatcagaggggaagtaaacaatatgacaaaacttttagacagagggtgcttactagtggtgggggggttaacaacagcaggagcggagaaatatgatgctgcgtggtggggtaggaagagagaaaaaagtgagggtcaatcgatgggagggggttatgagtcgatagaggaaaggagaaagatatttattaagccggggggggggtgatgaggcgtaagaactaagtg

SEQ ID NO: 337849 - DNA, 505 bp, Homo sapiens
gcggccgcggcccggactccgcggtgggcgagcgccctgtgaggtaagcggccggtgcgcagaggctgcgggcgaacttgggcggccgggggaggggacccggggcgcttccccaggcgaccgacccaggaggcgccgctcagtcctggccgaggctgagcgtctggtcgggcttcgggcatcaggggtctggcaggaccatgaggcgtaccctcaggccgcccgcggctccgcggtcccccggcatccggaggctcaggcgcgccgacggagagctatgccttggtttaccctcccgtaaaactaccggacgcggagcatgtatctccgcggtgcctccagccctgagatttttcgagtgtgtaagtaaagtcgaagaagaagaagctgactcttgggatgggaagagccttcacctaggaacgcaggggcaaatatggggctgggcacccactgtgtattttatgcaaatctcaaggggcaaatatggggctgggcacccact

SEQ ID NO: 337850 - DNA, 712 bp, Homo sapiens
tagtaacgcccgccagtgtgcgggaattcggctttcgagcgccgcccgggcaggtgtaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 337851 - DNA, 829 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaaaacaaaaacaaaatcgggctttatgtcgggggggggcaaacggggtttcgaagggcctgggccaaagggtccggcccgtttttgtacaggggaacgccg

SEQ ID NO: 337852 - DNA, 1285 bp, Homo sapiens
atacaaaaattagccaggcatagtggcatgtgcctatagtcccaactattcaggaggctgaaaaaaataaataaataaaataatgttaacaaaattctattagtatgagtattgagaaagaaggtgatttgggtagcttttttttggtcacaacacttttacacaggacagtaatatcacttctttagatctatatgtcgacacttagttttctagacatttctatgtacatgatcttattagaccctcttaatgactgaggtaggactgtatcagatgtgatctagagtatgttaagtgatatatagctaatcagtaagagacccaaaataggtgtccagctcttccggttctctagttcagtgttttcccatatcctctgcctttcaaatgagtttttaaaggtgaaaaatgcccatttgtttcctctagagttttgttccttttacagttaaaataaatcgctagagtaaagccttgtcatttgaaagagaattggatttatactttatggccctaaggggcaaactatctggagaaaaggttttatgtagtataagaatgaaatttacaataatagctgaatgacagtggaatgggctgctttggaaggcaactagtcccttttgctgggctgtacaggcacatgcttgaccatcacttggagttattttcaaaaacatgttgaataaacctgataattctataatgtagcctatgggctaatagatttgaaaactaattttagatttgtttttctttcagctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 337853 - DNA, 833 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcaagtgagtgtctcccgggctgtgactgtgagaccagcggggagctcaccgacgggcaccccttaactctaaggggtcatcggggccttcgaactgagctgaacgctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 337854 - DNA, 746 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattcacttccattctggatctttcacaagaatgtgaagtcaactaatgaggtctaaattttcttccttctacttcttctgtctcctatggtatcataacttatctccccttc

SEQ ID NO: 337855 - DNA, 936 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaacacaatacaaaaaacaaaaggggcggccgctcgcgatctagaaatctagtcctacgccgtgtgacagaggacgctcaggcggtgtcctcaggatgcccgatgtgggcagacccgcagccacctagcggtgcgagagtaccccagaagatcaagctcttggggaagtggacgccccgatgattgtgcagatcagtgacatttccctgcaggattaccttgccgtgacggagaagtttgccaagtacctgccctcaccagttgccggggggttaatgcccgcaaaggctttccggaaagctcagtgtgccattgtggagcgcctcaataagtccatgattgatgcgcggcgcaacaaagggcaggaaggtcatgatgttggcatcggtccaggattgcttggagatattaacctgcccccgggggaaccctctgaggcctgtggagcccccattcacgggccgggggaccacccatgggggcggcggtaaaacacggttt

SEQ ID NO: 337856 - DNA, 676 bp, Homo sapiens
ggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatatctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 337857 - DNA, 1763 bp, Homo sapiens
  misc_feature (841)..(841): n is a, c, g, or t
gcggccgcggcccggactccgcggtgggcgagcgccctgtgaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataagacaacatcaggtcacgtccagtttgacaactgcaactttgagaacgggcacatccaggtccatggcccgggtacttgccaagtgaagttctgtaccttcaaaaacacccatatcttcctgcacaacgtgcccctgtgtgtcctggaaaactgtgaatttgtgggcagtgaaaacaactctgtgactgttgagggtcacccatctgcngataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcttctagctccccaaagccaggctccaaggctggctcacaggaggcagaggtgggtagtgatggtgaaagggtggcccagaccccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactcatactgtgtaaccagatccaccatggccttcgctctggcattgtcgtccttggcaatgggaaaggcatcatccggaacaatcaaatcttttccaataaggaggctggcatttacatcctgtaccacggaaaccccgttgtgaggtgtgtgc

SEQ ID NO: 337858 - DNA, 2137 bp, Homo sapiens
  misc_feature (1215)..(1215): n is a, c, g, or t
tagtaacgcccgccagtgtgcgggaattcggctttcgagcgccgcccgggcaggtgtaagtcagagccgcgatgttccggattgagggcctcgcgccgaagctggacccggaggagatgaaacggaagatgcgcgaggatgtgatctcctccatacggaactttctcatctacgtggccctcctgcgagtcaagtgagtgtctcccgggctgtgactgtgagaccagcggggagctcaccgacgggcaccccttaactctaaggggtcatcggggccttcgaactgagctgaacgctccatttatcttaaagaaattggacagcatatgaagacaggacatcacatatgaatgcacgatatgaagagcctggttacagtttcgactcctctctgcaagtgaataggcccagaaaggtgtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataagacaacatcaggtcacgtccagtttgacaactgcaactttgagaacgggcacatccaggtccatggcccgggtacttgccaagtgaagttctgtaccttcaaaaacacccatatcttcctgcacaacgtgcccctgtgtgtcctggaaaactgtgaatttgtgggcagtgaaaacaactctgtgactgttgagggtcacccatctgcngataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcttctagctccccaaagccaggctccaaggctggctcacaggaggcagaggtgggtagtgatggtgaaagggtggcccagaccccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactcatactgtgtaaccagatccaccatggccttcgctctggcattgtcgtccttggcaatgggaaaggcatcatccggaacaatcaaatcttttccaataaggaggctggcatttacatcctgtaccacggaaaccccgttgtgaggtgtgtgc

SEQ ID NO: 337859 - DNA, 400 bp, Homo sapiens
ctggctcaggacagatggggaagaattcgtatattttagtacccctgaattaaagcattatacttaggcctaattgttattgactaaacaagaaaataagatgttaatccctaacagatacttcagttgttagagacttcatatttttggaaaactattgaaaagtttaagaaaatcccacaaactttcaatttggagttctcattatctcattaaatgaatagcactgcatataattaagctcccaagcaggtttaagatttgggagatgtgcaaatacagatcaccatgtgttcattcactatttggtagtccctcagaatggatttcagtgactctgtgttttaagaactcttaaaattctcctcccgtttttttggcagagagccaatgaaacatt

SEQ ID NO: 337860 - DNA, 396 bp, Homo sapiens
gtagaaaactcttaaagattctacaaaagaaatggtagaactaataaatttagtaaagtagcaaaatacaaaatcaacacacaaaccagctgcaattctatacattaacaatgaacaatatgaaacaagaaaattcaatttacaatggaatcaaagagaatacagatgctacttgacttacgatggggttaaatccctataaacccaccataaattgaaaatatcctaagtcaaaaatgcacttaatacacctaacgtaccaaacatcacagcttagcctatcctatcttaaacgtgctcagaacacttacattagtctagttcagcaaaaccatctaatacaaagctattttaaaataaagtgttgactacctcatgtaattaattcaacacttt

SEQ ID NO: 337861 - DNA, 798 bp, Homo sapiens
atgttgaaaacatttgtgttaggtctgctttttgtttgtttgtttgtttatccgagacagggtttggttctgttgcccaggctggagtgcagcggcacaatctcggctcactgcaaactctgcctccccggctcaagcgattcttgtgcctcagcctcccaagtagctgggattacaggcgcacaccaccatgcccagctaatttttttttgtatttggaagaggcagggtttcaccatgttggccaggctggtctcgaactcctgacctcaaatgatgcacctgccttggcctctgaaagtgttgggattacaggtgtgagtcaccacatccggccttgtgctaggttttctgaagcagactctaagtgtcacggatacagttgttaaaatggttctgtatatactcaatgattctccagttcatggaaacagaagacaatgaatttaatgatactgtgttctctgccagtattcactgatggagaaggggaagggtctttttaaataaagatttacttttcaactccaattcagattttcttgaaaataaaaggaatgtttgtcaaatcatcattttcactcagtaattcattatttcaataatcaaaataaaaaatgactgccatttgcattttctcatctatcttcatactgcatataaacaagataaatttaaagctccaaggaagggaagagaagatcttatttatgatccacccagacaggtgtgagaatttatgttccaacttcataagttgataataatgatttcacatatttttacaacatgattcag

SEQ ID NO: 337862 - DNA, 916 bp, Homo sapiens
aaattttctaccatagataacagaaaattctttcgcgcaagcatgtcattgtattaatgatattctcctgccctaaggaaatttacttcccttcaagcacagggtcccccaaattactgtatttccacccctttcagcttattttatccttttctcctgctacagaacagttggcattcaccattcccttcggtaaagtctttttttaggctgtggcttaaaggttgctttttcccccatagctcaaggttaggccttgtgacctcacttatgtaatttgagtgatttgatagcacaaatcaattttatacttaaattacagcataaaacagcactgcctcctgttggaaaaacttgcttgctaattttaaccagacacagtaaaaatactgtccaatacctcaaaaattgtgtaaatatatatccatttcaattgtcccccttcctctcctctccttttatctcttggaagataaaaatgtatgggtcctgtgctgataatgtttctgttcatatttctatgccctggtacctggatcagcttttgttctacacaaaaagacttgtatctggcttatttctgaaagctagtgttggccatgatgaacttttagagcaaaagatttcaggcagagtacattcttacatattcttacacaatcaatattcagttccagcccgcacagtagccctagcaaatgccagtgctccttccagagattcacctatggattcagtaccccagaagagaatttctgtaaattcttggggaagctatagctagactatggctcaacactcatttttcccccatgattcttaatctaacagtggcaatgttggcctcttcttaggcaactagattcggttcttgcttattctgccaataaaatactttattgagatgcttaaaaat

SEQ ID NO: 337863 - DNA, 619 bp, Homo sapiens
ttcctcgcccaaacaattgtttcctttttttgtgtgtcctaacaatgtgtttacataagcagatatatttatatatgtgtgtatttatgggtacatacatttatatatgtatgtgtatttgtatgttataaaattatatttacatagacaggtgaccttaaaacaacacacagctatgcactgtgcaggtccacttacaagtgagtttttttccataaacatattacaaaatgatctggagattttcagcaatctggaaaaactcagaaaccacgtcaccaataaatagcaaaacaaaataagaaaaagttaggtacgtcatgaatgcataaaatatacatagataccagtctatttatgtgttaatcaactgttgatgttatcagtaaggcttttggtcaacagaaggctgttggtagttaggttttgaaagagttgaaaattatgtgcggatttactgccatgtggggagttggtgcttctgacccctacattggtcaagggtcacctgcatcagtatgagtagttgcatgtgtgtgcattctgaaacactatggtaatagaagaaaaggaaagtgtggaagagcagatatgataggttccaatttgtgtgaaagag

SEQ ID NO: 337864 - DNA, 230 bp, Homo sapiens
ctgttgtgattcagtctgtgaatatttactgatcctgtgcctattttcttcagtgggattctcaattaaacaaactgcatggccatttgaaagcttattagacatagattttggacttgaaactgggtaagtttccaaagaaagaacgcgaatttttgcacaaaaccacattttgaattcatcagtagtcctcagcagcactacttcacagtctttgtgtagaaattgaa

SEQ ID NO: 337865 - DNA, 134 bp, Homo sapiens
tcaactgtgccagctaggaatctgtggatacagcacgcttctcccatctcagaagaaaaagcaaaacgtaccacttctgacaactcaccactggagagcatgagagaagcattaagtaagacctccctgacatc

SEQ ID NO: 337866 - DNA, 311 bp, Homo sapiens
agtgaatgcaaatagtccaacttcccataacaagcaccttctctccctacagacagagttacgtgggaagccaagtcagcatcaaactgttgcttggaaaaggtgggctcagaacaaaggaagttggatatatgattgcagtgtttaaaggtacctgaatgggacaggctgacaggtctgtcttgccaatgggaccatagcactatacacagaggcactgactaaggctctagtgaccccatgtagtgtagaacaggccctagcaacatttgtctctgggactccttcctcactttcatcactgaccagtg

SEQ ID NO: 337867 - DNA, 373 bp, Homo sapiens
aataaggcaaatatgaatacttacctcagagtgttgttgtgaagatggaatgaattaatggccataaagcacttacagctgtgtctggtacatagtgaccactcactaatggtcacttataattccttcacaacctgtaagggtcctttccacccaggtgatgtccctatgtctcaactgaatgactggttagggatatctttccatgggctactgtggctgcagataattgcattcttatttgagagttatgttaactagtgtgggcttttatttgcttctctctttctatcaatgagtcctgctgcttcaaccctgggttaactgaaatttgaaacctttttctactcaaattcctttgatgctgaaattc

SEQ ID NO: 337868 - DNA, 365 bp, Homo sapiens
gatataagctataaacaaagcgcttgtagtagtgtaatataagggagtaatagttgttgctatcgttattttttaattttaattgacatactaattatacatatttatgggataaaatatgatgcttcaatacatgtatacattgtgtaatgatcaaatgaaggtaattagcatatccatcacctcaaacatttataatttttgctgtgagaacagcaaagagatacattctggttgaacttgctacagaatagtaacaactgatgtgcttctgctagtctttttttttttttttttttttttggaaacaaattctccctctgtgcccaaggcggaattgcggggcccccatctcaccccatgga

SEQ ID NO: 337869 - DNA, 343 bp, Homo sapiens
acaggtgtaagccactgcgcccggccttggacacatcttttattgaaacgtggttaaatcaagaggttggaaaaggagtctatcttggtgtgaggcaatttgaagatatattgatccaggaggaagagaagttaaagaaaataaatggtgatagaagctcctgcggaagaagaggaagcaaagagcctgcagttatgactgagaacatgggcctgaaggagagtcagctccggccactgggaagaagcagggagcggaggtgggggacacgctggatatcaagcaggatacagttcctcgtcaggtttcttaaattcatggcatgaaaatcccagatatctca

SEQ ID NO: 337870 - DNA, 374 bp, Homo sapiens
tggcatacccccattagcagtggcctcgtataagcaggtgggcatgtaagtatgtgtgaatgtgttggggggcagatatggaatggaagcttgagaccctaatgctcactcattcattcaacatatattcattcaacatatcctggatgcacttttttaactatgggaaagacagcacaggacaaaaatcctggccggatgcggtggctcacacctgtaatcccagcacttttgggaggccagtgtgggcagattgcttgagtccaggagttcaagaccagcctaggcaacatggtttctaccaaaaatacaaaaattaccaaagaatcatcaaggtaaatatgaaattacacctttgagaaggatcaggaatg

SEQ ID NO: 337871 - DNA, 458 bp, Homo sapiens
tccaatacaataatagttggggacttcaataccctactctcagcatgagacaaatcatctagacagaaaattaacaatgaaataaccagatttaagctgtactttagactaaatggaccttacaaacatttacagaacatttcattcaatagctacagaatatacattcttctcatcagcacatggaacattctccaaggtagatcacatgttatgacacaaaacaagtctcgggggtggttccaagatggccgaataggaacagctccagtctacagctcccagcatgagcgacgcagaagacgggtgatttctgcatttccaactgaggtaccgggttcatctcactggggcttgttggacagtgggggcaggacagtgggtgcagcccaacgagcatgagccaaagcagggcaaggcatcgcctcaccagggaagcgcaaagggtcagggaattc

SEQ ID NO: 337872 - DNA, 4407 bp, Homo sapiens
  misc_feature (1)..(1): n is a, c, g, or t
nagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaa

SEQ ID NO: 337873 - DNA, 588 bp, Homo sapiens
ccatcaagcccaagtaactccttgtaccttcccaatacaaacctcccaattcaggttgattataatattatctgttatattgtgtcatggaatgacaaagttttaaggtattttgtaacccatatgaatgtatctctggagattataaaagaaatgttttagaaagtgaaatatatagcaaattatgccctttaatctttagaggttgtagttacaacatataaccaaaaaccaaacataaaaatttacatattcttgttttcttttttttttttttaggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttca

SEQ ID NO: 337874 - DNA, 4315 bp, Homo sapiens
  misc_feature (1)..(1): n is a, c, g, or t
nagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacaatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaa

SEQ ID NO: 337875 - DNA, 512 bp, Homo sapiens
ggagctcccatactattccagggactgttggaaggtaaaagaaccaatctttacccgtaagaagagcctactaagtgatgggttggaggttaatagggaagttgagtgtgtgagtcagcagaatgagccagcattcaatagctcagtgcaaaagcacacattcatcggttaaggtcttgttccttaatagagatggatcgtttgctggttggtgttaactgagatgcttcctgattaaaataatcagcaaatgaaaatgtatctcaattttcagaagctcatttcatatgaatcactttcgcttttctgggatttcaaataaattggagagcttgggtcaaatgatgttttagggcgctcacaactgttctcaatgcttaagagcttacttgaaagagtaagttacaagcctcttcatgagacatgagtcggacatcccaggggatgtttccctttgttatccaaaggacccggaacgttgtcctatcaggcacctgactcactggacctct

SEQ ID NO: 337876 - DNA, 488 bp, Homo sapiens
ctctctgggcacccactgatctgcagctgtgagtcttgtgatttccaatccatgcgcgttgagcaccttgtatgcttcacttacgtgatcaatgtacatattcaagatggccacagggtcccgagggaggggtctcagaagacctgtgttcattcacaatccaaggccatctctgagaaagggtggcaagggttctacctcatagggtggtggtgagcactgagcaagttgatgagtgtaaaagtgcccagcatgcagtaagcgctgcagaaacattaaccacaactatttctgtttactggcagacgtgacactgccccggatcatgaagcaagcacagtttgcaattcctctggcccacaagcctagagatactgcaacactggagaagttcgctttttttaaaatagggaattcccatgagttccatttttgcacaataaagtgtgatttgttttctcagagacagtctcgctctgtcacccagg

SEQ ID NO: 337877 - DNA, 1059 bp, Homo sapiens
ccttcaattaaaaaaaacctattttttccaagcacgataaagcaaagcacaataagattatgtatgccaatattctaaaacaaacaggatggaggagcatctagacattctttactgaatcttgtaataatcttactactcaaaggaaggtctgtggatcaggaacattgacatgttaggaatatagactctcagcccccaccccagcactacagaatccgatttcattttatcaagatgccccaggcaatttacatctacatcaaggtttaagagtccttgtaatcctggctctggcatttactagcagtgtgatgttagattgcataatctctgtgtccactttgtcaactgtaaaatagagggtggagtacaggaagacagggtgcatgtaattggatattgggatatctctagagataaggtacacaaatgttaaataacacctcttgcttagtaagcattggttattttcacgtgctaagtactttcaaaaacaactgtaaggggatacagctttcaaattctcttaagtatttgaactcatcgtctttaaacccttacccttatttatgtcatattaagggtttttagcctattgaaatgttggggagggtttttattcatctggtttagtctttcttccttagagatgagtaagcacaggaaaaataagcatttccaaagtcagcaaatagtgtttgtcctaataagccctaatatagacaaatggccataacttcaatcaatgaattatcaagttataaacttaaaaatatacacagaaacaatctagtaatttgtcgaaccttgaaggacactgactgcttaatggactttagtcataatatgttgtaaccctagattaactgaaatgggtgaaatggatatgtatatatagaataagtttgtgcaaagagaagataacctggttttcaacttctttgaaaacatgttttagtataatctttgtgcatcgtttagtaagtataatatattctattaagtttcatgtttgtcttatgtaatgatttggaaagcacatccaggtctttcagt

SEQ ID NO: 337878 - DNA, 223 bp, Homo sapiens
gtcaaaacatactataaaagtacaatgattaaaatactggatctggctgggcatagtggctcacgcctgtaatcccagcatttttggggaggccaaggtgggagaactgcttgagtccaggagttcaagaccggcctgagcaacacggcaaaccccttctttacaaaaaatacaaaacttagccaggcatggtggcatgcccctgtagtcccagctacctggg

SEQ ID NO: 337879 - DNA, 320 bp, Homo sapiens
agcgaaactccatctcaacaacaacaaaaaaaaaaagaagaagaagtaaattaggcgggcatggtggcaggcacctgtaatcccagctactcgagaggctgaggcaggagacatgttcccaaccaacggggaacaagagaccagaaggacaatgtgggaacgtgagtggcaatctaagccatgccatctccagtgatatataaggtgcctggttgcaatcttgcacggaggagtcccatgaatctagactgctggacagaagaaccagactggaggaaaagaggatctacaagagccccagttatcctggccccatgacc

SEQ ID NO: 337880 - DNA, 417 bp, Homo sapiens
tcaatcggactttactgtataggaaagtggtgcaaattttgctacctattttcacgaatgtgatcaatctcaggcaagtcagcttctttaaaaaatgtaaagtggagcctggaatacaagagaacaaaaagcaggaatttacattatttccataatggaaaacttgttatttttaaactatttcttgtgagggaccattagaaaatttaaatcatttctccagaagagagtacctttggaaattagacaaatgtacatattaactgattgatactacaaaggaatgtgtctagaataaattacttttttaatgtaaaccttagaacttgaaaaactgtaattctgggaaagctacatattcaggtacatattcaataaatatgaatgaacacatgacaaatatataacctacagtaa

SEQ ID NO: 337881 - DNA, 147 bp, Homo sapiens
cactgacatgaaggagacaacaaaccggcaggggctgtggcatttggtagggaaccacagtccttgctatcccatgtggtttgtggattgaaccagtgagtaagtaaatgaatgaatctgatttccagcctatttatcctatggccg

SEQ ID NO: 337882 - DNA, 170 bp, Homo sapiens
caaggtgtccattgtaggtgattaactatatgtcaataggtggagaaaggagggtgagacagggttagagagcatcatttaccagaaggaatggagggagggaatgagagaaggcaggaatggaaaggaaaaaaaaaatcctttggtttctttttttttttttttttttt

SEQ ID NO: 337883 - DNA, 523 bp, Homo sapiens
tctacctctcccttacttcctccttccaagaacatgggcacaatgttgagcacttggagatgagagatcaggaccagtcccagtcagatggggtctccctatattgtctgagctggtctctaactcccggctcaagcgatcctcctgccttggcctcccaaagtgctgagattacaggtgtgagcgaccacacccagccatgttcagtttttacacagccattacgatcaacagttatctcatttgtcttcttaaaacaatttttaaatgttgtttagagatgaatgttgctctgttgcccaggctggagtgcagtggtgcaatcatagcttactgcagccttgaattcctgtccttggctcaattgatccttccacctcagcctcctgagtagttgggactacaggctaaaggccagaatcactgccccaccgtgcagccttcagcagctgctcctctctggcctcagtgtcctcttagttcaatgggcatcaccaggtccctgtggtgccttccttgtcac

SEQ ID NO: 337884 - DNA, 171 bp, Homo sapiens
tcggatttcttaagcctaattgtctattagcgaagtagtctgacttcatcatacaggctcccagagtttcacgtggaagtgtgagttgccagtctgttgattttcagtgtcccttctgggctttccaagtgttcattgccatagacagtccagaattatcggtattgttct

SEQ ID NO: 337885 - DNA, 889 bp, Homo sapiens
cgggactacaggtgtgggccaccacacccagctagcattgtttttattgtttctgtttcacaggagagagtaacttgacaagagacatagccagtgagtgatagacccaggacttgaacctgtgcctcctgaccacagatgctttgcccttttgctcttacgcctgaattagagctgcctctgtcctcagggactggtagggagtgaggaagacagcactcacagaaatgaggaggcgactggctgtgaggaccctgcagcacagagagtaataagcatagacaggaggggcagtaagagttgagaagttggggactgtcagggaagacctcaaagagaaagtgggatctcaggtgaactttgaagaatagggatgattttttagaaggcactggcaggcatcacaggcaaccagtcacccagcggctgctctgggtgctagggacacagtggtaaacaagacaggcagtcttgtcctcaaactgagggcagagtcgggaggcagaatatagtcaagaaaccatcaacaagagacgtgaaaacaatagagcagtgtggtagagagtgactgggccacgccttaggggacatgtggggacatgaggcagccatgctaaaatctgaaggttttggggtggaaagggcagcaagtatcctcagctggggacgaggccctgagataggaatggtttggtgggttcaagggtcaagaaaaatacagaggctggagcaacatgaagaaggaagagtgaaggcaaataagggcacagaaggctttatcaggcccaacggcaaagcctgcgagctgtgctgaatttagcgcgtatgtcagaatttagttaggggaagcctttggagggagggtttgaagcaaagggaaagacatctc

SEQ ID NO: 337886 - DNA, 500 bp, Homo sapiens
ctcactcatcttgagaatgaggaagagttaacccagaacaaagaaagggtagttgatgtttagtgtttgggcagatgtattccaagcaaagggaacattattggtaaaagaagaaaggggattgagagcccagagtcttcggagagctgtaaatattcagtctgacgggggtgtcaaggcacagaagcgaagtttggagtttatgctaccgacaatggggatctctaaaaggagttcagaaagatctgaaaatagactcaaagatttcttcaacaaaaggagatgggtgtctgaaaatgatgaagatgtggtccctgactccaaagagctcatcacctactgggagagacagatatgtaaacaaatcattacagaacaatttgtttcattctaaatgtagcacacaaaaagagctggggacagtgaagaggaagccgtcagcgctgcctgcggagaagaaaggaaggctttgtgtaggtgacaactgagcaagatgacag

SEQ ID NO: 337887 - DNA, 1017 bp, Homo sapiens
ggggtcagtgtgatatgtgtaaaaatccttggtaacccaaagggaagatgcagggagtttttttatttgcagaaatgctccagaattaggatatagtagcatgttctagactatctctgcttttgaaaatatggactatgacttcattcatccaaccagatatttatgtatttatttttcgagactgagtctcgctctatcgcccaggctggagtgcagtggtgcgatatcagctcactgcattgtctgcctcccaggttctagtgattctcctgcctcagcctcccaagtagctgggattacaggcacccaccaccatgcctgggtagtttttgtgtttttagtagagacatggtttcaccatgttggctaggctggtctcgaactcctgacctcaagtgatctgcccacttccgcctcccagggtgctgggattacaggcgtaagccactgcgcctggccccaaccagatatttttaatagctaactatatgctaggcattctccttgctggagttttagcagtaaataagcaaacacgcccctgcccttaaggagcatatattcaaatgggagagatagataatatccaagtacacaaatatagaatttggaggctagaagtccaaaatcagcttgtcagcagggctgtgctccctccaaaggctccaaggaagaatcctccattacctcttccagcatctggaggccccaggcattccttagcttgtggtggcatcacatcagtcttcccatggccttttcctctgtgtgtctgtcttctgctctctcttttataaaggacacctgttattggatttagggcctcctaggtaatccaggatgatctcatcttgagatccttaatttcatttgcaaagaccctttttcccataaggagatagtcaaagcttcttgggattaggatgtggacatatcttttgggagccaccagttaaccaggtaaaatatggaacctgggagaataacttcaacagcaggtattaaatcaaaatt

SEQ ID NO: 337888 - DNA, 130 bp, Homo sapiens
atgttcacttgtgcttgtattgagattaacttcggcctccagaggttattttttcaggaattttttttttaagctacttgtccattttgtaaaagttagcttaaattcactctaaattcatcatctgagc

SEQ ID NO: 337889 - DNA, 480 bp, Homo sapiens
cccttcaaaaacaatctgctcctccttcccatatctcacttaaatgtgggcgtctccatccttccaaacacacagactagaaagtcttgagttgttccctattctttatttccctcttcgcacagtaagtcaccaaattctgtggacagttctttggaaaggtctcaaatctctacctctttcccttccatatcactgtcaaaatgatgcctctacaagtctgagcctgtcaatgcttagtttaaaattctctatttactctagcctgattacagcaaactccgtccaaacagcccaatataacctaaaggtagtattatgacctaaagctcattgtactgtgaaaccaacctagctttccagttctgtcttcctcaactctacttcacccccagcatctttcttctaacatccccttttcatacttctgtgaaccacttatactccagaagccttaatgtgaattattagcccagcatg

SEQ ID NO: 337890 - DNA, 396 bp, Homo sapiens
aactccatcttaaaaaaaaaaaaaaaggtttttttgggagtattatattccattaaatttcttcagtttctgatttggttcctcctgtgtttgtcttgtcacatattgtgttatgcctctgactctggaacttttttggatattgagaatctttggcatgagaacttaagggaatctgaggcagagaaattgaatggtgtttctcagatgttgtccgcttttgtttcacttgtgccctcttgttcaccctttcttttttatcactgtaccgtaaagcattgtttgtaaaagcctgagtatacacagacatattgacagtaaacaacactgaaatggactgacttgagaaaatttcatgtatagaaaataagcaaaaacaaagtaagaaacactgca

SEQ ID NO: 337891 - DNA, 294 bp, Homo sapiens
  misc_feature (224)..(224): n is a, c, g, or t
tgataggactctgtctcatcctcagggggtaagtgtgtgtgtgtgtgtgcgcgcacacaggaaacctcttgtttttaaatatttccttctccaaacagcctgccgctgaccttcccggcctctgtgtggctctcaggccacctccttattgctatatcttggagcctggccttcccatgagggagctggaggttctggggctgcacctttgactcagcagcggngtgctgccagccccatcagggcccagttggtggggatcaggggcgtgtcagtgcgaggcaggtgtgagag

SEQ ID NO: 337892 - DNA, 460 bp, Homo sapiens
actagtcttcatttcttgactgaaccccctcacctctgttccttccttctgaaattctccttaccctcactttcccttctttctgtctcttcacttggttaataatcttcacagctcagttcaaatgtcactttcctgggaaatcttcccccagtgctaggtcaggccatcccttgatctattcccatgttttctcctcattgcactcatcacagttgataattgtaaatttagttgtgtggtgatctgtctgcttctcccaccagacattaacccccttgtgggtcgagatggtgccccctttgcttactattgtatcccaacatcctggcatatggccaggctcatggacaatactaaagaatggttgggtgggtgaagggatggatatctcgtgtcaggtgatgcatgaatggcactactgtctaactcacgatgaaaccaaatgttatgcttttgc

SEQ ID NO: 337893 - DNA, 303 bp, Homo sapiens
tgtaagacatgatactattttcttagaccagtgcctgacattgattaaaacttcagtaaacgtatcgaatactgaatgaatggaattaggtttagacctgtgtaggaacatgcagtatgctttattataatgtatgcgattgtatatatttattatccagctttttcacagctgccatcatccagcattacctactataactgtgattccgccttctttgagccagatgtaaaactacactgttgtaacttttaagggttaacgtgcatttgccttcattctagaaataggtttatgcttttg

SEQ ID NO: 337894 - DNA, 627 bp, Homo sapiens
cccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatca

SEQ ID NO: 337895 - DNA, 375 bp, Homo sapiens
tcctggaaattgtgcggaaatgcagttggtttttccctgccccgcaccctgctgagctctcgttagtggtaatagcttctcagtggagtccgcaggactttgtgcacacaggatcctgtcatctgtgattcgagctagttttatttgttccctttcaacctggctgccttttgtcttcttccctaattgtcctggctgagacctctagttcggtgttggctggatgtggtgagccgggcgccctggtcttagggagagcgtgcggtttttgaccatcgagcatgatgttggccgtaggccgtgcgtgccctttgtcagaccctgggccctcccttctgtgcctcggctattccatatttttgtcctgtagaggtg

SEQ ID NO: 337896 - DNA, 1745 bp, Homo sapiens
ggccagctgcccaaggccaggaggggagacagagatcccgggacaaatgtgcagcaggcccctgagcatgtgtagaaatgttgtcatcatttccacatagaaagacttggaggaaatcaaagaagacagtaaaagtcacaagatcctatccaaccttcccttccctgaatgcctgggaagaattcaggggcctcttgcctgtggatggagagccgaaccctggagcgggcctaggtgtggaggagggactgctctgccgggtggttcattctccagaattcaacctgtttcttgactccgtggtgtttgaaagcaacttcatccaggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcatcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaatgttttcttccctgctcagaccattctggacaaatgtgaactgccagacaccttccatttccctttctatctgtttttcttgctagttcctgtcttctgattaaagcttcattccttctttgt

SEQ ID NO: 337897 - DNA, 422 bp, Homo sapiens
ttctcaccggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtgctggagcaggggtgtgatctgaatgaccagagggaaggactgatggaattggatggtgagagcctccaggccctttaggcttctccctgactttataatgaaatacaaaagtcagcctccaaaaaaatcc

SEQ ID NO: 337898 - DNA, 716 bp, Homo sapiens
ggccagctgcccaaggccaggaggggagacagagatcccgggacaaatgtgcagcaggcccctgagcatgtgtagaaatgttgtcatcatttccacatagaaagacttggaggaaatcaaagaagacagtaaaagtcacaagatcctatccaaccttcccttccctgaatgcctgggaagaattcaggggcctcttgcctgtggatggagagccgaaccctggagcgggcctaggtgtggaggagggactgctctgccgggtggttcattctccagaattcaacctgtttcttgactccgtggtgtttgaaagcaacttcatccaggtattcttgggtggcgcagaatagcactctttgattcttcgaaacctgttcccaagatatgactgagagagtccatccctgaaactggggcagagtgagaattgaggcaaggagaagctagtggacctggaatgcaaggccaccctcactgacctgggctttgctgagccccagacggggcttctcctacagacagctgtcacccagggagaaaggtcaggggtcctctgctctgagtggagaatttggtattctaatcccccagtttacttcagcccccaggctgtcacctgaagtagatgaacaaagaggcagtaaaaagagacgcttcttgagaacaataatgcggattggcgaaagaacagcacctggggtccagagacagctggg

SEQ ID NO: 337899 - DNA, 1643 bp, Homo sapiens
ttctcaccggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcatcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaatgttttcttccctgctcagaccattctggacaaatgtgaactgccagacaccttccatttccctttctatctgtttttcttgctagttcctgtcttctgattaaagcttcattccttctttgt

SEQ ID NO: 337900 - DNA, 360 bp, Homo sapiens
accaagggggagagtgaagccctgtctcagatttttgccgacttacaccagcagaaccagttgaggtacatgacttaaatcaagccagcctctgacattccctcctgcaacccagatggtctgggctgtgagatccagaaaccaaatagcttggttaatgagcgcagggttttacgtgaccaggcacggtggctcacgcctgtattccccgcactttgggaggtcaaggcagatggattgcttgaggtcaggaatttgagaccagcctggcctcgatatactgccactcactatccagtctttttttttttttttttcctttttgagataggctctcactccgtcgcccagggttcaagc

SEQ ID NO: 337901 - DNA, 1766 bp, Homo sapiens
ttctcaccggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtgctggagcaggggtgtgatctgaatgaccagagggaaggactgatggaattggatggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcatcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaatgttttcttccctgctcagaccattctggacaaatgtgaactgccagacaccttccatttccctttctatctgtttttcttgctagttcctgtcttctgattaaagcttcattccttctttgt

SEQ ID NO: 337902 - DNA, 505 bp, Homo sapiens
gtttctcatagctatcaaaagctactaaaaggtttacatatattggtaataagcaaaatgacctctgaatgaaattaagagggtaggatctagacacactggtgggtcttaaggtttctcagcattgtctggccatgctgaatttttgctttagtatctcagatgcggtgcagaaaaatggaaggtccacacttttactcctctccatcagcaggagcatctgaacacagggctttatactagatatgaccaactgcattcaaaattttcatgaacagtaaccagtaaaagcattacccacaaaaaaatccccttacattcaaagaatgccagatgaagaataaaatgaacagctgggcgcggcagcgcttgcttgtaatcccagctatgcagaaggctgaggcaggagaaacgcttgaacctagaaggcagaggttgcagtgagcggagatcgctccactgcacttcagcctgggtgacagagcaggactccatctcaaaaaaa

SEQ ID NO: 337903 - DNA, 1411 bp, Homo sapiens
acccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaactctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgccagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagct

SEQ ID NO: 337904 - DNA, 485 bp, Homo sapiens
atgctcccagtgatgcacttcttaacacttcacaaagccccagtacacagtgttaacccaactactgttttctcatctgtataatttttattatgctcatctttctcattatctgtgaggattaagtgtttagaatgattaaggagataagattcggcctaagcgaggccttgatgccattcagggattaaaggagataaaacatttaaggcgttggcacggggcctggtagttataagtgctcaataaatatcaggtttttttttttaaaaaaaagtagttgacatcttaacccaaagtaaatgagggtggatgtctacacatagacttgtacaccaatattcactgcagcagattcaaaacagccccagactggaaacagcccaaatggccaaccatggccaggtggataaatgcatcattgtacatccagatggtgggatactcagccctaaaaatggtgaaccactgctgatccgcacgac

SEQ ID NO: 337905 - DNA, 797 bp, Homo sapiens
gtcagagcccaggggtttgtcttttgagtcctgaactcctcatcagcaaatggaaaatggtatttgtaaaccacacgacataggttctgtctgagggggtctaagcgtcattatctaggacagagcctgtagaacagctaatcattccagaatgtcagctgagagccagccataaagaggccgggcacaggcctatggccactgattcctatctgggcccctgagtcaaaaagtgaccccagcaatgactcccttcacagtctccgagcaaactctcctaagccctgggcacagggcggttaaaggttcttcctctcagaagacttaacatggttattaaattttgatcctaaccaatctctcttcttaaggttttttcatgacacgttgagtatgccaatttttaatgttttatttttctaaattttccaagaagctgccttacaacgcagtgcacagcaagactgtgtaccactgagcccatccatcaatgctagctctcgcaagggaatcgctggaaacattctcatgctgttggctcaatcaagatggttcttttcaaagtgtctaagctgtaattctttgacaactctgactttctcaggctttcagcaaaacactgctaaaattcaagggaaaccacaactcaaaaggccttctcactgctttggcacagagcgcccccaaagtcctgcaagccatcaaaagactcagcttgcaaacccaggctctgtctggagagggagagagggagagagggagagcacactttctggcaggggagcagctggggagtt

SEQ ID NO: 337906 - DNA, 2372 bp, Homo sapiens
atttttaaaagcctcggaaaggtgataccatctgacagtcattttctcacgttggtcttctaaagtcacctatttcttgtgtgtgcacatcacaccatttcctgtttctttataacccgacaagggtaggagtgcctgtttcccctgctgggcacaccagacaatcgtaatcacaaaacagacactgagccagggcccaaagggtgtgatcatgagagttaccgggacagcagtaggcatgacagtcaccaggaaggacaagggtgctctgttgttagtggccacacaccaatttgacaaggagtgttgcgaaatttttatttatttatttatttattttgagatggagtttcactcttgttgcccaggctggagtgcggtggtacaatctcggctcactgcaacctccacctcccaggttcaagcgattctcctgcctcagcctcccaagtacctgggactacaggtgcgtgccaccacacccagctaaattttgtgtttttagtagagatggggtttcaccatgttggccaggatggtcttgaacccctgacctcatgatctgcctgcctcggcctcccaaagtgctgggattacaggcatgagccaccacgcccagccaaaatatttttttaaagtcattttccttaagctgcttgggctacatgtgaaatacactggacggtcaacattcctgtctcctcccatttgggctgatgcagcagatccagggaatgttacctgtttctgctgctagaagatccaggaaattgggaaggttacctgacgcacacatggatgaaggccatcatctagaaatggggtcaaccacaatgtgttaattccgtagtgtcagggattcttcgggaaggtcaacagtatgaaggattctgacccctgtgcctcccatttatgtgatcaggtgacagttaataaccgtggaggtcacactcagccatccaacagccttacagtgaccctacacaaaagcccccaaattccaaagactttttcttaacctaaaggaagaaattatttgttaattccagtagagcaactgaatatactgggctatttgtacttttttatagagaactttaataataattctttaaaaatgagtttttagaacaaagcaactgacgatttcctaagattccaatgccctggagcttgtaggaggacttagcctgggtcagctggagcacccccgacctgatctcccactgccagattttcccatgctcctagggtatggagtccacgtgggaatgactgcaagttcaggtggaacttggccgactgatgctctgcgagtttttaatagacactggggacaactgcttaaggtttagaaacttccaaaccacaggaaagacatttttagtgtcccccatccagaggcagccctggaataggattcccaggggtttctgggacccctttccttgctccgtgaggctctgtggccatcttttggcaggaggaggatgcttccttggctctgtgcccagacccgcctggtccccaggtctctcaccttgggtgaagattcagagatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgctttttttttcagtttgtataacctctaatctccgtttgcatgatacgctttgttagaaacattaattgtagtttggaagcaagtgtgtatgaataaagataatgatcattcctttgtgtagttggcct

SEQ ID NO: 337907 - DNA, 2319 bp, Homo sapiens
atttttaaaagcctcggaaaggtgataccatctgacagtcattttctcacgttggtcttctaaagtcacctatttcttgtgtgtgcacatcacaccatttcctgtttctttataacccgacaagggtaggagtgcctgtttcccctgctgggcacaccagacaatcgtaatcacaaaacagacactgagccagggcccaaagggtgtgatcatgagagttaccgggacagcagtaggcatgacagtcaccaggaaggacaagggtgctctgttgttagtggccacacaccaatttgacaaggagtgttgcgaaatttttatttatttatttatttattttgagatggagtttcactcttgttgcccaggctggagtgcggtggtacaatctcggctcactgcaacctccacctcccaggttcaagcgattctcctgcctcagcctcccaagtacctgggactacaggtgcgtgccaccacacccagctaaattttgtgtttttagtagagatggggtttcaccatgttggccaggatggtcttgaacccctgacctcatgatctgcctgcctcggcctcccaaagtgctgggattacaggcatgagccaccacgcccagccaaaatatttttttaaagtcattttccttaagctgcttgggctacatgtgaaatacactggacggtcaacattcctgtctcctcccatttgggctgatgcagcagatccagggaatgttacctgtttctgctgctagaagatccaggaaattgggaaggttacctgacgcacacatggatgaaggccatcatctagaaatggggtcaaccacaatgtgttaattccgtagtgtcagggattcttcgggaaggtcaacagtatgaaggattctgacccctgtgcctcccatttatgtgatcaggtgacagttaataaccgtggaggtcacactcagccatccaacagccttacagtgaccctacacaaaagcccccaaattccaaagactttttcttaacctaaaggaagaaattatttgttaattccagtagagcaactgaatatactgggctatttgtacttttttatagagaactttaataataattctttaaaaatgagtttttagaacaaagcaactgacgatttcctaagattccaatgccctggagcttgtaggaggacttagcctgggtcagctggagcacccccgacctgatctcccactgccagattttcccatgctcctagggtatggagtccacgtgggaatgactgcaagttcaggtggaacttggccgactgatgctctgcgagtttttaatagacactggggacaactgcttaaggtttagaaacttccaaaccacaggaaagacatttttagtgtcccccatccagaggcagccctggaataggattcccaggggtttctgggacccctttccttgctccgtgaggctctgtggccatcttttggcaggaggaggatgcttccttggctctgtgcccagacccgcctggtccccaggtctctcaccttgggtgaagattcagagatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacgggctggcaccatccatacccctccccagtgtcaggggtcaggaggtaaccttacataagagttggattgtgtttattgtatagagagccccaggcaggggtaggtacagcttttaaataaaaggcgcctggtcatgttcgatttgttcaacaaaaaaaaaa

SEQ ID NO: 337908 - DNA, 314 bp, Homo sapiens
ctgattattcactcatcaaacactgatgtctaaaatctgtacccagatttttagggggtacaaaggggatgataggaacgcaacatatttcctttggtgggttcccagacccgtgtgagagacagacactggtcaagtgcagtaagcgtgtgagcagcccctgctcacctgaagctcactggtgttctcattcctgtctccctcaggtgctggctgcattctgtggtgggcagggcctgggatggggctggccaaggggcctgagctgtgctggctgccctccgcatggtgaggctataggtcttgcctgattt

SEQ ID NO: 337909 - DNA, 213 bp, Homo sapiens
atgttgaatgcatgttcttgtgatgattgtacaaatgaggaagtcacagtaagtttagagttgagcgtgtgggtttcaagtcttctctgtaacccataatgatcagccttcaacaagtcagcaatcccctctgaacttcagtttccttatgtataaaatggaaataatagggccagacacggtagctcacacctgtaatctcagcactttggg

SEQ ID NO: 337910 - DNA, 471 bp, Homo sapiens
aaaaaggaaagagatagtttgcttttaaggaacttcactgtgtggcaaaaactagtgtaaacaatgacaatacagaatactaagtggtctggtaggtgttatgtatgcagtactttgggagtgtggaggaaggcatgcctagaataatcagggaggacttcacagagtggttatttatagtttaagcagagacataccagtaagagggaatagcatatgcaagtggccagaaatccttggctagctatctgggaggagtggggttgtcaggagataaaggtataaagataggcttatatgccgcgctgtatagttgaatgtttttactattacaaaattttacagatgccctcagtttctccctttattcatttttctatgacatctttattgttggtcttcatttagtctttccttccagtctatcctgtgtaaaattacttcctacttccaaaatgagaaatactgggt

SEQ ID NO: 337911 - DNA, 262 bp, Homo sapiens
aaaaaggaaagagatagtttgcttttaaggaacttcactgtgtggcaaaaactagtgtaaacaatgacaatacagaatactaagtggtctggtaggtgttatgtatgcagtactttgggagtgtggaggaaggcatgcctagaataatcagggaggacttcacagagtggctaatttttgtatttttagaagagatggggtttcaccacgttggttaagctggtcttgaactcctgaccttatggtccgcctgcctcagcct

SEQ ID NO: 337912 - DNA, 363 bp, Homo sapiens
ctctacttaaatttgtaacctaaatgcctcacacctcattttctgaacaaataaagcccaaattcagtgtcctttttgataggatcctgtcctgacctttccaaatctgatgctagagccttgtgtaccctgagttcagccaaactgaactcttaatggtcccttgctccatactctccccttgctcatgcctttattctcctggtctgattcatctttgcatcttaacagtgtatagcatggtgccttctttttactggggacatatcgagttaatgaatgaatgatgctattacagaggtacagtttgggaaggggagtgagtacattttagaaaggtgataagtggattgtcagccttca

SEQ ID NO: 337913 - DNA, 1282 bp, Homo sapiens
atataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcaaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcgctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccatgaaatctggttaggctggtgttagggttctttgtttttggggtttggcagagatgtgtttaagtgctgtggccagaagcggggggagggggggtttggtggaaattttttgttatgatgtctgtgtggaaagcggctgtgcagacattcaattgttattattatgtcctacaagcattaattaat

SEQ ID NO: 337914 - DNA, 1463 bp, Homo sapiens
  misc_feature (558)..(558): n is a, c, g, or t
  misc_feature (573)..(573): n is a, c, g, or t
  misc_feature (606)..(606): n is a, c, g, or t
  misc_feature (635)..(635): n is a, c, g, or t
  misc_feature (643)..(643): n is a, c, g, or t
  misc_feature (903)..(903): n is a, c, g, or t
  misc_feature (906)..(906): n is a, c, g, or t
  misc_feature (908)..(909): n is a, c, g, or t
  misc_feature (912)..(912): n is a, c, g, or t
  misc_feature (915)..(917): n is a, c, g, or t
  misc_feature (919)..(920): n is a, c, g, or t
  misc_feature (922)..(922): n is a, c, g, or t
  misc_feature (928)..(928): n is a, c, g, or t
ctcattatgctcatccctccttactaccagacaacttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagaccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccagacaaccttagccaaancatttacccagatanagtataggcgatagaaattgaaacctggcgcantagatatagtaccgcaagggaaagatganaaattatnaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaatttgccacagaacctctanatncnnctnggnnnanntntaacgngttagtccaaagaggaacagctcttgggacactaggaaaaaacctggtagagagagtaaaaaatttaacacccatagtaggcctaaaagcagccaccaattaagaaagcgtcaagctcaaaacccattacctaaaaaatcccaaacttttaactgaactcctcacacccaatgtggaccaatctatcaccctatagaagaacctatgtcacgtcatcagtaccatgacaacttttctcctccgaaataagcctgcgtcagattaaacactgacatggacattaaacaggcccattatctaccatcaaccaacaagttcttattaccctccctggtgaacccaataagggcgtgccatacaggagacgcgtcccacaccggctaaaggaacgccggcaacttaacccggcgtgttgccaaaaaataacgcataagcaccagattaaagaacccgccacaacagatatagacgcagaccacacgggaaaggggacacacggctgctacacaaaaaacacaaaaagcggggaaaacag

SEQ ID NO: 337915 - DNA, 1483 bp, Homo sapiens
  misc_feature (578)..(578): n is a, c, g, or t
  misc_feature (593)..(593): n is a, c, g, or t
  misc_feature (626)..(626): n is a, c, g, or t
  misc_feature (655)..(655): n is a, c, g, or t
  misc_feature (663)..(663): n is a, c, g, or t
  misc_feature (923)..(923): n is a, c, g, or t
  misc_feature (926)..(926): n is a, c, g, or t
  misc_feature (928)..(929): n is a, c, g, or t
  misc_feature (932)..(932): n is a, c, g, or t
  misc_feature (935)..(937): n is a, c, g, or t
  misc_feature (939)..(940): n is a, c, g, or t
  misc_feature (942)..(942): n is a, c, g, or t
  misc_feature (948)..(948): n is a, c, g, or t
ctcattatgctcatccctccttactaccagacaacttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagaccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcacgccaacttactaccagacaaccttagccaaancatttacccagatanagtataggcgatagaaattgaaacctggcgcantagatatagtaccgcaagggaaagatganaaattatnaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaatttgccacagaacctctanatncnnctnggnnnanntntaacgngttagtccaaagaggaacagctcttgggacactaggaaaaaacctggtagagagagtaaaaaatttaacacccatagtaggcctaaaagcagccaccaattaagaaagcgtcaagctcaaaacccattacctaaaaaatcccaaacttttaactgaactcctcacacccaatgtggaccaatctatcaccctatagaagaacctatgtcacgtcatcagtaccatgacaacttttctcctccgaaataagcctgcgtcagattaaacactgacatggacattaaacaggcccattatctaccatcaaccaacaagttcttattaccctccctggtgaacccaataagggcgtgccatacaggagacgcgtcccacaccggctaaaggaacgccggcaacttaacccggcgtgttgccaaaaaataacgcataagcaccagattaaagaacccgccacaacagatatagacgcagaccacacgggaaaggggacacacggctgctacacaaaaaacacaaaaagcggggaaaacag

SEQ ID NO: 337916 - DNA, 1169 bp, Homo sapiens
  misc_feature (609)..(609): n is a, c, g, or t
  misc_feature (612)..(612): n is a, c, g, or t
  misc_feature (614)..(615): n is a, c, g, or t
  misc_feature (618)..(618): n is a, c, g, or t
  misc_feature (621)..(623): n is a, c, g, or t
  misc_feature (625)..(626): n is a, c, g, or t
  misc_feature (628)..(628): n is a, c, g, or t
  misc_feature (634)..(634): n is a, c, g, or t
ctcattatgctcatccctccttactaccagacaacttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagaccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaatttgccacagaacctctanatncnnctnggnnnanntntaacgngttagtccaaagaggaacagctcttgggacactaggaaaaaacctggtagagagagtaaaaaatttaacacccatagtaggcctaaaagcagccaccaattaagaaagcgtcaagctcaaaacccattacctaaaaaatcccaaacttttaactgaactcctcacacccaatgtggaccaatctatcaccctatagaagaacctatgtcacgtcatcagtaccatgacaacttttctcctccgaaataagcctgcgtcagattaaacactgacatggacattaaacaggcccattatctaccatcaaccaacaagttcttattaccctccctggtgaacccaataagggcgtgccatacaggagacgcgtcccacaccggctaaaggaacgccggcaacttaacccggcgtgttgccaaaaaataacgcataagcaccagattaaagaacccgccacaacagatatagacgcagaccacacgggaaaggggacacacggctgctacacaaaaaacacaaaaagcggggaaaacag

SEQ ID NO: 337917 - DNA, 1034 bp, Homo sapiens
accccatttaggctaaagcagcacaattaagaaagcgttcaagctcaacacccactacctaaaaatcccaaacatatactgaactcctcacacccaattggaccaatctatcaccctatagaagaactaatgttagtataagtataggcgatagaaattgaaacctggcgcaatagatatagtaccgcaagggaaagatgaaaaattataaccaagcagatgaccccaatacgcaaaactaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatccgggcgaggcctatattacggatcatttctctactcagaaacctgaaacatcggcattatcctcctgcttgcaaatatagcaacagccttcataggctatgtcctcccgtgaggccaaatatcattctgaggggcccacagtaattacaaatttatattcgccatcccattacatttggcgacagaccttagttcaatgaaatctgaggaggctactcagtagaacagtcccacctcacacgaattcttaactttcacttcatcttggcccttcattattgccagcctaagaagaatcaactcctattcttgcacgaaacgggatcaaaaacccctaggaatcacctccaatccgataaatcccctttcaacccttagtaacaatccaagacggcccctcggttaattcttaccttgctccttatgacatttacactaatctcacagaactcctaaggaaccagaaattatacctaaaaccttaaaaccttccaataaggccaaggaataccaatggatac

SEQ ID NO: 337918 - DNA, 452 bp, Homo sapiens
tgatggctggtaggatgtcagctgtcgccgagtctgtgttgctatgaagaaatacctgaggctgggtaatttataagagaagtttaattggctcatgtttctgtaggctttataggaagcacggtgttggcatctgcttggcttccagggaggcctcaggaagctttcaattatgacggagggcaaaggaggagcaggtgtctcacgcagtgcgagtgggagcaagatggggtgaggtcatgccacacacttaaccagatctcttgagaaatcactcactctcatgagaacagcaccaaagagatggtgctaaccatttatgagaaatctgtccccatgatttaatcacccgtcacccatccccacctcccacattggggattacatttcaatgtgaggtttacaggcaacatcatccaacatatcagagtgcagctcacattactgtctgg

SEQ ID NO: 337919 - DNA, 195 bp, Homo sapiens
cgtcaatgaagaggcaagatgaggctggatgttggaaaaagtctccttggaagagctgctctgctgagtgcagttaagcagaaaactgaaagatgaaaatgtaggggtcagaaaagggattttcttatatgacaggtttaagtgttttgagtgctcatggggtgtaagatgtagatctggaataagtggcggggg

SEQ ID NO: 337920 - DNA, 626 bp, Homo sapiens
ttcaagtgatcctcttgcttcagcctctggagtagctaggactaggagcacaggtcacctctcctggctttctttttcataattcttgcagttttaatccctcccttcccgtactaccagagcagttttgaaacctctattattacgttttatcagggtctgccatatactagtttatctgagtgtttgtcttccagattagagttatggttcctcgacaggcagataatcatgtcttctttgtttagagatgaataaacacctagcatggtgctctgaatatagtatgtgcttaacaaatgcttgttggattgaaccagtatgaatttaagttcttttgttggacagagaggtatgcctgctttagagctgtttcctctcctcctgagatctttctgtgctgttttactgagcagggaagaatagcgttgctaaatgcatgtttaccaaaatgacattttatttttgggacttttatgattccttatggacttcttagtgtgagaattatggagagtttatagctttgaaatggtggtatagagtttttgagatggagtttagctcttgtctcccaggctggagtgcaatggcacaatctcagctcattgcaacctttgcctccc

SEQ ID NO: 337921 - DNA, 355 bp, Homo sapiens
tactactactaaattcgcggccgcgtcgacttcattctctgctttagtctcaggggagaatggtttgactgttggtttctgaatcagatatgggctgtaccatcctgctttcccatggacagaaacagcctgctctctgggttcaccttctgaagcctgcaatagagaaaggtaataatgagtctcttttctgtacctgcctccctactctcttcctctgtcctttaccttctccagcctcatccatacatgaatgcctgtaaccaagacagcagcttcctgagtgcctccaatttccccagccttttgggaccaccttccagctgacagtgcaatagaatggcttgaatctttt

SEQ ID NO: 337922 - DNA, 487 bp, Homo sapiens
acaaggataatagctgaagttataagaatcagtatcagaggaaaacaaagtttgtagccaaagtcgttttgcaaaaaatatgtcatgaccctggtcaaaggattttaatagcactcagactcttgagtttttttccatagccttctccctcaacccactgcttcaggcatatttgtcttctttctattccctgaactctccaaccacttgtcacttgaccatcttggccttgggtgacctttgatcttggaatgctcttctccaggtagtcacattgctgaattgcctatcacttccttagaaagtcttccctgatccgcacgaagtgaagtaatcaaaaggtcatatttactcatatgggtcatatttactcatatgactgtgttttaattctttgaatagcatttctgcaatcttattttattactttgattgattgactgatttactggctattttcctccataactccccccgtggaaaagta

SEQ ID NO: 337923 - DNA, 475 bp, Homo sapiens
ctctctgagtactgggctccacaacttcacatttagagtaagaatgcatacttcccagggtcatggagagaaatcagtgagagtgtatgtgaaaaccctttgaacatcataaggcacaacgcaaatgtgaaattatttattattggcatgggaaggtcaaggatgcagtggtagctcagaagcagaaggtttcaaggtaatggggctgagctgccagagtttgctggggaaaactagacccctccttgagcaggccgagggaagcaggctgcaaaaacatcacaaccgggcaaagttctcttccttgggcctggacagaccattacaaggtactgttgagagtgaaagaatgggaccctcggcccattgggcaccccatgggttattttctgtgctctgttctgttttgcttcatttttaattctgggtttttctcagtttatggctttaacaattatgcgtgatgctgagcctg

SEQ ID NO: 337924 - DNA, 348 bp, Homo sapiens
agacaactttcatttatttaagacagagctttttccgaagcaaataaccttttgttacatctccagagaaatgacatttcctttcccttttcctgctttgcaaggacagcagatgcgtggggggagaaactgaaacaaatggaaagtaaggcaggcacaggctccttcgcgttccttctccatgagcatccctcaccgagcatgctgaaggcatggctgtgcttccttcaatttgtcacacatcagagacagcgcacagcctctgatctctagaggaagttatccattccactctgtctgacctaaataataaattctaggccgtgcagcctggaatgattcctgtct

SEQ ID NO: 337925 - DNA, 9801 bp, Homo sapiens
  misc_feature (2572)..(2572): n is a, c, g, or t
  misc_feature (2605)..(2605): n is a, c, g, or t
  misc_feature (2633)..(2633): n is a, c, g, or t
  misc_feature (2839)..(2839): n is a, c, g, or t
  misc_feature (3546)..(3546): n is a, c, g, or t
  misc_feature (4857)..(4857): n is a, c, g, or t
  misc_feature (5026)..(5026): n is a, c, g, or t
  misc_feature (5254)..(5254): n is a, c, g, or t
  misc_feature (5722)..(5722): n is a, c, g, or t
  misc_feature (6161)..(6161): n is a, c, g, or t
ggcacgaggagctgcctcacccccggccccgggaagggcatggccccggcaaactcccggccgtgactcgcgcgccccggctcggtggatgctcccggcgcaccgctcccgtgtgcggcggcttcccaaggacaggtatccgagaatcaggcaccccgacaagatgcccaagcgcgcgcactggggggccctctccgtggtgctgatcctgctttggggccatccgcgagtggcgctggcctgcccgcatccttgtgcctgctacgtccccagcgaggtccactgcacgttccgatccctggcttccgtgcccgctggcattgctaaacacgtggaaagaatcaatttggggtttaatagcatacaggccctgtcagaaacctcatttgcaggactgaccaagttggagctacttatgattcacggcaatgagatcccaagcatccccgatggagctttaagagacctcagctctcttcaggttttcaagttcagctacaacaagctgagagtgatcacaggacagaccctccagggtctctctaacttaatgaggctgcacattgaccacaacaagatcgagtttatccaccctcaagctttcaacggcttaacgtctctgaggctactccatttggaaggaaatctcctccaccagctgcaccccagcaccttctccacgttcacatttttggattatttcagactctccaccataaggcacctctacttagcagagaacatggttagaactcttcctgccagcatgcttcggaacatgccgcttctggagaatctttacttgcagggaaatccgtggacctgcgattgtgagatgagatggtttttggaatgggatgcaaaatccagaggaattctgaagtgtaaaaaggacaaagcttatgaaggcggtcagttgtgtgcaatgtgcttcagtccaaagaagttgtacaaacatgagatacacaagctgaaggacatgacttgtctgaagccttcaatagagtcccctctgagacagaacaggagcaggagtattgaggaggagcaagaacaggaagaggatggtggcagccagctcatcctggagaaattccaactgccccagtggagcatctctttgaatatgaccgacgagcacgggaacatggtgaacttggtctgtgacatcaagaaaccaatggatgtgtacaagattcacttgaaccaaacggatcctccagatattgacataaatgcaacagttgccttggactttgagtgtccaatgacccgagaaaactatgaaaagctatggaaattgatagcatactacagtgaagttcccgtgaagctacacagagagctcatgctcagcaaagaccccagagtcagctaccagtacaggcaggatgctgatgaggaagctctttactacacaggtgtgagagcccagattcttgcagaaccagaatgggtcatgcagccatccatagatatccagctgaaccgacgtcagagtacggccaagaaggtgctactttcctactacacccagtattctcaaacaatatccaccaaagatacaaggcaggctcggggcagaagctgggtaatgattgagcctagtggagctgtgcaaagagatcagactgtcctggaagggggtccatgccagttgagctgcaacgtgaaagcttctgagagtccatctatcttctgggtgcttccagatggctccatcctgaaagcgcccatggatgacccagacagcaagttctccattctcagcagtggctggctgaggatcaagtccatggagccatctgactcaggcttgtaccagtgcattgctcaagtgagggatgaaatggaccgcatggtatatagggtacttgtgcagtctccctccactcagccagccgagaaagacacagtgacaattggcaagaacccaggggagtcggtgacattgccttgcaatgctttagcaatacccgaagcccaccttagctggattcttccaaacagaaggataattaatgatttggctaacacatcacatgtatacatgttgccaaatggaactctttccatcccaaaggtccaagtcagtgacagtggttactacagatgtgtggctgtcaaccagcaaggggcagaccattttacggtgggaatcacagtgaccaagaaagggtctggcttgccatccaaaagaggcagacgcccaggtgcaaaggctctttccagagtcagagaagacatcgtggaggatgaagggggctcgggcatgggagatgaagagaacacttcaaggagacttctgcatccaaaggaccaagaggtgttcctcaaaacaaaggatgatgccatcaatggagacaagaaagccaagaaagggagaagaaagctgaaactctggaagcattcggaaaaagaaccagagaccaatgttgcagaaggtcgcagagtgtttgaatctagacgaaggataaacatggcaaacaaacagattaatccggagcgctgggctgatattttagccaaagtccgtgggaaaaatctccctaagggcacagaagtacccccnttgattaaaaccacaagtcctccatccttgagnctagaagtcacaccaccttttcctgctntttctcccccctcagcatctcctgtgcagacagtaaccagtgctgaagaatcctcagcagatgtacctctacttggtgaagaagagcacgttttgggtaccatttcctcagccagcatggggctagaacacaaccacaatggagttattcttgttgaacctgaagtaacaagcacacctctggaggaagttgttgatgacctttcngagaagactgaggagataacttccactgaaggagacctgaaggggacagcagcccctacacttatatctgagccttatgaaccatctcctactctgcacacattagacacagtctatgaaaagcccacccatgaagagacggcaacagagggttggtctgcagcagatgttggatcgtcaccagagcccacatccagtgagtatgagcctccattggatgctgtctccttggctgagtctgagcccatgcaatactttgacccagatttggagactaagtcacaaccagatgaggataagatgaaagaagacacctttgcacaccttactccaacccccaccatctgggttaatgactccagtacatcacagttatttgaggattctactataggggaaccaggtgtcccaggccaatcacatctacaaggactgacagacaacatccaccttgtgaaaagtagtctaagcactcaagacaccttactgattaaaaagggtatgaaagagatgtctcagacactacagggaggaaatatgctagagggagaccccacacactccagaagttctgagagtgagggccaagagagcaaatccatcactttgcctgactccacactgggtataatgagcagtatgtctccagttaagaagcctgcggaaaccacagttggtaccctcctagacaaagacaccacaacagnaacaacaacaccaaggcaaaaagttgctccgtcatccaccatgagcactcacccttctcgaaggagacccaacgggagaaggagattacgccccaacaaattccgccaccggcacaagcaaaccccacccacaacttttgccccatcagagactttttctactcaaccaactcaagcacctgacattaagatttcaagtcaagtggagagttctctggttcctacagcttgggtggataacacagttaatacccccaaacagttggaaatggagaagaatgcagaacccacatccaagggaacaccacggagaaaacacgggaagaggccaaacaaacatcgatataccccttctacagtgagctcaagagcgtccggatccaagcccagcccttctccagaaaataaacatagaaacattgttactcccagttcagaaactatacttttgcctagaactgtttctctgaaaactgagggcccttatgattccttagattacatgacaaccaccagaaaaatatattcatcttaccctaaagtccaagagacacttccagtcacatataaacccacatcagatggaaaagaaattaaggatgatgttgccacaaatgttgacaaacataaaagtgacattttagtcactggtgaatcaattactaatgccataccaacttctcgctccttggtctccactatgggagaatttaaggaagaatcctctcctgtaggctttccaggaactccaacctggaatccctcaaggacggcccagcctgggaggctacagacagacatacctgttaccacttctggggaaaatcttacagaccctccccttcttaaagagcttgaggatgtggatttcacttccgagtttttgtcctctttgacagtctccacaccatttcaccaggaagaagctggttcttccacaactctctcaagcataaaagtggaggtggcttcaagtcaggcagaaaccaccacccttgatcaagatcatcttgaaaccactgtggctattctcctttctgaaactagaccacagaatcacacccctactgctgcccggatgaaggagccagcatcctcgtccccatccacaattctcatgtctttgggacaaaccaccaccactaagccagcacttcccagtccaagaatatctcaagcatctagagattccaaggaaaatgttttcttgaattatgtggggaatccagaaacagaagcaaccccagtgaacaatgaaggaacacagcatatgtcagggccaaatgaattatcaacaccctcgtccaaccnggatgcatttaacttgtctacaaagctggaattggaaaagcaagtatttggtagtaggagtctaccacgtggcccagatagccaacgccaggatggaagagttcatgcttctcatcaactaaccagagtccctgccaaacccatcctaccaacagcaacagtgaggctncctgaaatgtccacacaaagcgcttccagatactttgtaacttcccagtcacctcgtcactggaccaacaaaccggaaataactacatatccttctggggctttgccagagaacaaacagtttacaactccaagattatcaagtacaacaattcctctcccattgcacatgtccaaacccagcattcctagtaagtttactgaccgaagaactgaccaattcaatggntactccaaagtgtttggaaataacaacatccctgaggcaagaaacccagttggaaagcctcccagtccaagaattcctcattattccaatggaagactccctttctttaccaacaagactctttcttttccacagttgggagtcacccggagaccccagatacccacttctcctgccccagtaatgagagagagaaaagttattccaggttcctacaacaggatacattcccatagcaccttccatctggactttggccctccggcacctccgttgttgcacactccgcagaccacgggatcaccctcaactaacttacagaatatccctatggtctcttccacccagagttctatctcctttataacatcttctgtccagtcctcaggaagcttccaccagagcagctcaaagttctttgcaggaggacctcctgcatccaaattctggtctcttggggaaaagccncaaatcctcaccaagtccccacagactgtgtccgtcaccgctgagacagacactgtgttcccctgtgaggcaacaggaaaaccaaagcctttcgttacttggacaaaggtttccacaggagctcttatgactccgaataccaggatacaacggtttgaggttctcaagaacggtaccttagtgatacggaaggttcaagtacaagatcgaggccagtatatgtgcaccgccagcaacctgcacggcctggacaggatggtggtcttgctttcggtcaccgtgcagcaacctcaaatcctagcctcccactaccaggacgtcactgtctacctgggagacaccattgcaatggagtgtctggccaaagggaccccagccccccaaatttcctggatcttccctgacaggagggtgtggcaaactgtgtcccccgtggagngccgcatcaccctgcacgaaaaccggaccctttccatcaaggaggcgtccttctcagacagaggcgtctataagtgcgtggccagcaatgcagccggggcggacagcctggccatccgcctgcacgtggcggcactgccccccgttatccaccaggagaagctggagaacatctcgctgcccccggggctcagcattcacattcactgcactgccaaggctgcgcccctgcccagcgtgcgctgggtgctcggggacggtacccagatccgcccctcgcagttcctccacgggaacttgtttgttttccccaacgggacgctctacatccgcaacctcgcgcccaaggacagcgggcgctatgagtgcgtggccgccaacctggtaggctccgcgcgcaggacggtgcagctgaacgtgcagcgtgcagcagccaacgcgcgcatcacgggcacctccccgcggaggacggacgtcaggtacggaggaaccctcaagctggactgcagcgcctcgggggacccctggccgcgcatcctctggaggctgccgtccaagaggatgatcgacgcgctcttcagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgaacacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttacttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatcagcgagaagatcacggccatggcgggccacaccatcagcctcaactgctctgccgcggggaccccgacacccagcctggtgtgggtccttcccaatggcaccgatctgcagagtggacagcagctgcagcgcttctaccacaaggctgacggcatgctacacattagcggtctctcctcggtggacgccggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaaa

SEQ ID NO: 337926 - DNA, 9695 bp, Homo sapiens
  misc_feature (2572)..(2572): n is a, c, g, or t
  misc_feature (2605)..(2605): n is a, c, g, or t
  misc_feature (2633)..(2633): n is a, c, g, or t
  misc_feature (2839)..(2839): n is a, c, g, or t
  misc_feature (3546)..(3546): n is a, c, g, or t
  misc_feature (4857)..(4857): n is a, c, g, or t
  misc_feature (5026)..(5026): n is a, c, g, or t
  misc_feature (5254)..(5254): n is a, c, g, or t
  misc_feature (5722)..(5722): n is a, c, g, or t
  misc_feature (6161)..(6161): n is a, c, g, or t
ggcacgaggagctgcctcacccccggccccgggaagggcatggccccggcaaactcccggccgtgactcgcgcgccccggctcggtggatgctcccggcgcaccgctcccgtgtgcggcggcttcccaaggacaggtatccgagaatcaggcaccccgacaagatgcccaagcgcgcgcactggggggccctctccgtggtgctgatcctgctttggggccatccgcgagtggcgctggcctgcccgcatccttgtgcctgctacgtccccagcgaggtccactgcacgttccgatccctggcttccgtgcccgctggcattgctaaacacgtggaaagaatcaatttggggtttaatagcatacaggccctgtcagaaacctcatttgcaggactgaccaagttggagctacttatgattcacggcaatgagatcccaagcatccccgatggagctttaagagacctcagctctcttcaggttttcaagttcagctacaacaagctgagagtgatcacaggacagaccctccagggtctctctaacttaatgaggctgcacattgaccacaacaagatcgagtttatccaccctcaagctttcaacggcttaacgtctctgaggctactccatttggaaggaaatctcctccaccagctgcaccccagcaccttctccacgttcacatttttggattatttcagactctccaccataaggcacctctacttagcagagaacatggttagaactcttcctgccagcatgcttcggaacatgccgcttctggagaatctttacttgcagggaaatccgtggacctgcgattgtgagatgagatggtttttggaatgggatgcaaaatccagaggaattctgaagtgtaaaaaggacaaagcttatgaaggcggtcagttgtgtgcaatgtgcttcagtccaaagaagttgtacaaacatgagatacacaagctgaaggacatgacttgtctgaagccttcaatagagtcccctctgagacagaacaggagcaggagtattgaggaggagcaagaacaggaagaggatggtggcagccagctcatcctggagaaattccaactgccccagtggagcatctctttgaatatgaccgacgagcacgggaacatggtgaacttggtctgtgacatcaagaaaccaatggatgtgtacaagattcacttgaaccaaacggatcctccagatattgacataaatgcaacagttgccttggactttgagtgtccaatgacccgagaaaactatgaaaagctatggaaattgatagcatactacagtgaagttcccgtgaagctacacagagagctcatgctcagcaaagaccccagagtcagctaccagtacaggcaggatgctgatgaggaagctctttactacacaggtgtgagagcccagattcttgcagaaccagaatgggtcatgcagccatccatagatatccagctgaaccgacgtcagagtacggccaagaaggtgctactttcctactacacccagtattctcaaacaatatccaccaaagatacaaggcaggctcggggcagaagctgggtaatgattgagcctagtggagctgtgcaaagagatcagactgtcctggaagggggtccatgccagttgagctgcaacgtgaaagcttctgagagtccatctatcttctgggtgcttccagatggctccatcctgaaagcgcccatggatgacccagacagcaagttctccattctcagcagtggctggctgaggatcaagtccatggagccatctgactcaggcttgtaccagtgcattgctcaagtgagggatgaaatggaccgcatggtatatagggtacttgtgcagtctccctccactcagccagccgagaaagacacagtgacaattggcaagaacccaggggagtcggtgacattgccttgcaatgctttagcaatacccgaagcccaccttagctggattcttccaaacagaaggataattaatgatttggctaacacatcacatgtatacatgttgccaaatggaactctttccatcccaaaggtccaagtcagtgacagtggttactacagatgtgtggctgtcaaccagcaaggggcagaccattttacggtgggaatcacagtgaccaagaaagggtctggcttgccatccaaaagaggcagacgcccaggtgcaaaggctctttccagagtcagagaagacatcgtggaggatgaagggggctcgggcatgggagatgaagagaacacttcaaggagacttctgcatccaaaggaccaagaggtgttcctcaaaacaaaggatgatgccatcaatggagacaagaaagccaagaaagggagaagaaagctgaaactctggaagcattcggaaaaagaaccagagaccaatgttgcagaaggtcgcagagtgtttgaatctagacgaaggataaacatggcaaacaaacagattaatccggagcgctgggctgatattttagccaaagtccgtgggaaaaatctccctaagggcacagaagtacccccnttgattaaaaccacaagtcctccatccttgagnctagaagtcacaccaccttttcctgctntttctcccccctcagcatctcctgtgcagacagtaaccagtgctgaagaatcctcagcagatgtacctctacttggtgaagaagagcacgttttgggtaccatttcctcagccagcatggggctagaacacaaccacaatggagttattcttgttgaacctgaagtaacaagcacacctctggaggaagttgttgatgacctttcngagaagactgaggagataacttccactgaaggagacctgaaggggacagcagcccctacacttatatctgagccttatgaaccatctcctactctgcacacattagacacagtctatgaaaagcccacccatgaagagacggcaacagagggttggtctgcagcagatgttggatcgtcaccagagcccacatccagtgagtatgagcctccattggatgctgtctccttggctgagtctgagcccatgcaatactttgacccagatttggagactaagtcacaaccagatgaggataagatgaaagaagacacctttgcacaccttactccaacccccaccatctgggttaatgactccagtacatcacagttatttgaggattctactataggggaaccaggtgtcccaggccaatcacatctacaaggactgacagacaacatccaccttgtgaaaagtagtctaagcactcaagacaccttactgattaaaaagggtatgaaagagatgtctcagacactacagggaggaaatatgctagagggagaccccacacactccagaagttctgagagtgagggccaagagagcaaatccatcactttgcctgactccacactgggtataatgagcagtatgtctccagttaagaagcctgcggaaaccacagttggtaccctcctagacaaagacaccacaacagnaacaacaacaccaaggcaaaaagttgctccgtcatccaccatgagcactcacccttctcgaaggagacccaacgggagaaggagattacgccccaacaaattccgccaccggcacaagcaaaccccacccacaacttttgccccatcagagactttttctactcaaccaactcaagcacctgacattaagatttcaagtcaagtggagagttctctggttcctacagcttgggtggataacacagttaatacccccaaacagttggaaatggagaagaatgcagaacccacatccaagggaacaccacggagaaaacacgggaagaggccaaacaaacatcgatataccccttctacagtgagctcaagagcgtccggatccaagcccagcccttctccagaaaataaacatagaaacattgttactcccagttcagaaactatacttttgcctagaactgtttctctgaaaactgagggcccttatgattccttagattacatgacaaccaccagaaaaatatattcatcttaccctaaagtccaagagacacttccagtcacatataaacccacatcagatggaaaagaaattaaggatgatgttgccacaaatgttgacaaacataaaagtgacattttagtcactggtgaatcaattactaatgccataccaacttctcgctccttggtctccactatgggagaatttaaggaagaatcctctcctgtaggctttccaggaactccaacctggaatccctcaaggacggcccagcctgggaggctacagacagacatacctgttaccacttctggggaaaatcttacagaccctccccttcttaaagagcttgaggatgtggatttcacttccgagtttttgtcctctttgacagtctccacaccatttcaccaggaagaagctggttcttccacaactctctcaagcataaaagtggaggtggcttcaagtcaggcagaaaccaccacccttgatcaagatcatcttgaaaccactgtggctattctcctttctgaaactagaccacagaatcacacccctactgctgcccggatgaaggagccagcatcctcgtccccatccacaattctcatgtctttgggacaaaccaccaccactaagccagcacttcccagtccaagaatatctcaagcatctagagattccaaggaaaatgttttcttgaattatgtggggaatccagaaacagaagcaaccccagtgaacaatgaaggaacacagcatatgtcagggccaaatgaattatcaacaccctcgtccaaccnggatgcatttaacttgtctacaaagctggaattggaaaagcaagtatttggtagtaggagtctaccacgtggcccagatagccaacgccaggatggaagagttcatgcttctcatcaactaaccagagtccctgccaaacccatcctaccaacagcaacagtgaggctncctgaaatgtccacacaaagcgcttccagatactttgtaacttcccagtcacctcgtcactggaccaacaaaccggaaataactacatatccttctggggctttgccagagaacaaacagtttacaactccaagattatcaagtacaacaattcctctcccattgcacatgtccaaacccagcattcctagtaagtttactgaccgaagaactgaccaattcaatggntactccaaagtgtttggaaataacaacatccctgaggcaagaaacccagttggaaagcctcccagtccaagaattcctcattattccaatggaagactccctttctttaccaacaagactctttcttttccacagttgggagtcacccggagaccccagatacccacttctcctgccccagtaatgagagagagaaaagttattccaggttcctacaacaggatacattcccatagcaccttccatctggactttggccctccggcacctccgttgttgcacactccgcagaccacgggatcaccctcaactaacttacagaatatccctatggtctcttccacccagagttctatctcctttataacatcttctgtccagtcctcaggaagcttccaccagagcagctcaaagttctttgcaggaggacctcctgcatccaaattctggtctcttggggaaaagccncaaatcctcaccaagtccccacagactgtgtccgtcaccgctgagacagacactgtgttcccctgtgaggcaacaggaaaaccaaagcctttcgttacttggacaaaggtttccacaggagctcttatgactccgaataccaggatacaacggtttgaggttctcaagaacggtaccttagtgatacggaaggttcaagtacaagatcgaggccagtatatgtgcaccgccagcaacctgcacggcctggacaggatggtggtcttgctttcggtcaccgtgcagcaacctcaaatcctagcctcccactaccaggacgtcactgtctacctgggagacaccattgcaatggagtgtctggccaaagggaccccagccccccaaatttcctggatcttccctgacaggagggtgtggcaaactgtgtcccccgtggagngccgcatcaccctgcacgaaaaccggaccctttccatcaaggaggcgtccttctcagacagaggcgtctataagtgcgtggccagcaatgcagccggggcggacagcctggccatccgcctgcacgtggcggcactgccccccgttatccaccaggagaagctggagaacatctcgctgcccccggggctcagcattcacattcactgcactgccaaggctgcgcccctgcccagcgtgcgctgggtgctcggggacggtacccagatccgcccctcgcagttcctccacgggaacttgtttgttttccccaacgggacgctctacatccgcaacctcgcgcccaaggacagcgggcgctatgagtgcgtggccgccaacctggtaggctccgcgcgcaggacggtgcagctgaacgtgcagcgtgcagcagccaacgcgcgcatcacgggcacctccccgcggaggacggacgtcaggtacggaggaaccctcaagctggactgcagcgcctcgggggacccctggccgcgcatcctctggaggctgccgtccaagaggatgatcgacgcgctcttcagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgaacacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttacttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatctgcagagtggacagcagctgcagcgcttctaccacaaggctgacggcatgctacacattagcggtctctcctcggtggacgccggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaaa

SEQ ID NO: 337927 - DNA, 292 bp, Homo sapiens
ccgcccaccttggcctttcaaagtgttgggattacgggagtgagccaccacgcccaggccacaactttttaaatatattaaacgccatggaaatgtgtactttgaaaggtgattgtttttcatatgtgaattatctatcaatttaaaaaacaatcaaacctctgcacttccagctatctctttctcttctttcaacatttccagccaggttaatctaatacgtgtctgggacaaaacacttgtattattcatgcttctgcacctttaatctaagctagtcccagtcctctct

SEQ ID NO: 337928 - DNA, 312 bp, Homo sapiens
tcaagaatctaaatgctagatgtttaggcaatatagttttggggtcaggggtacttacttttctttcctttttatgtttaatctttttggtgtctaatactacttagtaccacatttttcaccgagcagtttcggagtaaaaagatattctggcaagttcatatcagcttgatttttattttcagatgaacaggttgccaaccccttaagtggcttgctatcatagaaacagaccatttcggtgatagatctgtcccttagttgattgattggcgtagaggaattagcagtctgtgaaatgctcttcagaag

SEQ ID NO: 337929 - DNA, 1032 bp, Homo sapiens
gccaggtgcggtgacgcatttctatattcctagctacttggaaggctgaggtgggaggatcacttgggcccaagagttggaggctgcagtgagctatgatacaccttgcactccagcctgggtgacaaaggaccctgtttctgaaaaataaataaatagaaacaaaatagaatattacatacctgttaaaagaaaaatgtagcctgggtgcgatggctcacacctataatcccagcactttaggaggctgaggcaagaggatcacttgagaccagcctgggcaacactgtgagacctcttctctatagaagaataaacaaaattagccgggcatggtggctcactcctgtagtaccagctactcaggaggcccaggtgggaggattgcttgagcctaggaagtcaaggctgcagtgagctaagattgtgccactgtcctctaacctggttgacagagcgagaccctgtctcagaaaagaaaaggccaggcgcagtggctcatgcctgtaatcccagcactttgggaggccgaggcaggtggatcacaaggtcaggagtttgagaccagcctggccaagatggtaaaaccctgtctctactaaaaataaaaataaaaaattagccaggcatggtggcaggtgcctgtaatcccagctgcttgggaggctgaggcaggagaattgcttgaattcgggaggtggaggttgcagtaagccaagatcacgccactgtactccagtctgggtgacagagtgggactccatctgaaaaaacaaaaaagaaaataaaaaaaatgcagggcataaactttgattcggaatgtccataatacatcattaaatgatgaagtcaacttagaaaactattctagtttgatcccatttttgtgaaaacttacatttacacacagaagcatacatagcaataataattctaggtagttggtggcagtagaactaggatgaaacattgatacagctgtgggtttgaatgtcttagtaaaaaacatacatttctatcaaaacttaaaat

SEQ ID NO: 337930 - DNA, 244 bp, Homo sapiens
cactgtgattctaggcgtgagccactgcgtctggcctgatttttttcccttttcatgcgtgttttctctgcgtggtgccatcctggagggtcttcccctttcagtggtcctttttcccaaacctagcctggtgtgccctctgggctggtccgttctccctgccgtctgtctccctcctcttcccacatctcactctttcttcccccacttcctctcccaccggcctctggggtagcgctgtcca

SEQ ID NO: 337931 - DNA, 646 bp, Homo sapiens
gaatccagagtattattttttaatacaataaaactcacttaaaagcaggtggggtgggggtagtggtggtggtgatagtaagggatctggcaccttttgctaacactcactgtagcgattcagcaacagtaagtaataataaaaacaaattctataaaaagcaggctgaagttttaccactcaatgacattttgatcctatgtgtacctcaatgaataaaggaaaattattagaagtcagttgctttccctaaacaattttagccacagatagagccttttcaaaaggtttgaaaactgtgacaaaagtgcatttagccctgaaggtttaagatgctcctgcagtctgcatttctccaataaataaaaagggaacaattaaaaagccacttataagtacctcaaaagcactgatccttaatttattgattctttggagactaataaaaatggtgaaaggaaaagaacatacataccagcagaaaaacactgattaatttgattaaaataatccaatattctaaaacaatttcgtttaagttcttcaagttctcaaaattatatggctaaacaattaacaagggctgggtgtggtacctcatgcctgtagttctagcactttgggaagccaaggtgggaggactgct

SEQ ID NO: 337932 - DNA, 134 bp, Homo sapiens
agtataaaaaaatgtgtggtgtagagtcaagttataaaacatgtttaattggaattctaacaatagagaagaaaatgaacataggcaatatttgaagaaacaatagctcaaaggtttccaaaattgatgaaaga

SEQ ID NO: 337933 - DNA, 806 bp, Homo sapiens
gcagtgagccatcattgcactacctgcactccagcctgatgacagagcaagaccctgtctcaagaaaaaaaataaagaaagaaaatacttgtttcattaacaattctttgcatgtggggagcccttgtatttaacctattaaataaacaaatcttaattatgactaccagcatttccccaatcttgtctctgctattataataccattttttaaataaaatgattatacagttaggatgccttcttccttgcagcaacacttattttgcaaatttgcagttgtatttaggctaccaccagcaactctcttggcaaacattgagcaactcctaccacaaaaattaatgagtagagagacaaggtctgcacacctactcattttgttcttccattatcaagttgtgggactctggggaagtgatccaggggacatctacagaaaccaaaaatggagttttgtaacactgtgagttgtttattcttgtaaataataggatcttcttgactggactggaagcttcaaggaagctgtgtcttctgtttttcgtgtgcatccttcgtggttctaaatatgatgctacatgaatataaggtgtttcctgtcgttgtgggctggtggagctgtgagggcttcagtgggataaactggaagaaggagcctgggttatgaagttcagtggatgcttcttgggttttctcttccttgacctccccggaccgtaaattcctccttgaaatacttgcttctgaatcacaaagtttctctcctgcctccctggccgccttttctcagctgcctttgtgtg

SEQ ID NO: 337934 - DNA, 343 bp, Homo sapiens
ccaggcatcactgatctcctttttgtctctatagattttccttttctagatatttcaaataacttgaatcacaatatgtaatcttttgtgtctggcttcctttacttagcataatgtttttgaggtccgtctgtgttgtagcatgtttcaatagttaattcctgtttattgtagaatagtattctattgtgtagaaatacaacatttcatttttctatttacaagttgatgaacacttggattattcccacatttggtctatgatgaataattctgctttgaacatttgtgtaaaagtcttgcagtggacagacagaggccttgttaatttttattagatgtg

SEQ ID NO: 337935 - DNA, 392 bp, Homo sapiens
atcttggagacatcatttaaactgtaaacctttggaatttctagacttgtgtgggcaaagagagataatgaagtgggaaattattaaaagacccagcatttcggcatggtctctgtctccccagtaagccccttgaacccagggactggattttactcccatttctttatatttacagccccttgtacaccgctcagcccagagtaaactctcaaaaaattttttgataatgttcttaaggtcacaccgtcatgtgattgtttcaccatttctacccctttagcctgcccccaacccctgtgttgggaggtgtttccaaggctggcttagttattagatctgatcctgcttagaagtagatgaagaaaaagtaaggaaatgtgtcattcagc

SEQ ID NO: 337936 - DNA, 490 bp, Homo sapiens
caagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctca

SEQ ID NO: 337937 - DNA, 532 bp, Homo sapiens
agtggtttcttagttatgacaattgaccagtcatgtgagatgagaacatcaggagaagcaaactgggggaggggaatacaagaactctctgttgtcttcattaattctctgtgcgtctaaaattattccaaaataaaaagtttattgagaaaatacattagcaacatggaaaatgcttatgatataatattaaatgaaaaaaaggatgacaggtatctgctcagggtaaaaaagaagataaatggggagagaaggaggaagtgagagttggcttcctcctacctgtcccacctcgtctcaactccctgattccattcttgctgatgcagccgcccaaaggagtatctgccactttatttcctgccagttcaaatcccatcccatcagctctcattaagaaaccctttccggccgggcatgatggctcatacctgtaatcccagcactttgggaggccaaggcggacggatcacctgagggcggatcacctgaggagttcgagagcaggctggccaacatggtgaaaccccgt

SEQ ID NO: 337938 - DNA, 574 bp, Homo sapiens
  misc_feature (314)..(314): n is a, c, g, or t
  misc_feature (318)..(318): n is a, c, g, or t
  misc_feature (324)..(324): n is a, c, g, or t
  misc_feature (326)..(326): n is a, c, g, or t
  misc_feature (335)..(335): n is a, c, g, or t
  misc_feature (344)..(345): n is a, c, g, or t
gattatgcacttctgcctcctgactgattctttcacctaatacttcctgagtttagtatcttaggtaactctctttgaataacagcagccctacacacaagaacaccgtggctttacagtggagatgggaaaagagttcaaaaccacctgcttatttctttctataacatattttcaccttagccacagaaaaaagaagacccacagctacctcggaaaagctccccgaaatccacagcgcctgtcatggatttgttgggccttgatgctcctgtggcctgctccattgcaaatagtaagaccagcaatacccnaganaaggantnagatctgtnggcctctgnnccatccccttcttcttccatatgccttctttagctggtttcactcattcctgtggctctgtcacctctatgcttattgctgccaagtgtgcatcaccatcccatctgaatattttctcctacacatcacactcttttatccagatgcctactggacataactggttcaatgcccacagacatcacaaaattcaatgtatacaaaaccgacctcagtcccttctccctaa

SEQ ID NO: 337939 - DNA, 345 bp, Homo sapiens
ttttgccaaggattccttctcagtgccactctcctctgatttccagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaaggcaagttctctctggcctccccactcgactccccaccccactctctatcgtttgtctctctcaaaacacaggatgaagttgttctctgaagttcctttatctacctaaagtgtggacataccaaaggggga

SEQ ID NO: 337940 - DNA, 525 bp, Homo sapiens
aggttgaccacctgtttcatgcagcttagggtcagaagaatctgtagctctgtcaagaagacgcagggctacagataggaaacaggagggaataatccagccagaaattatcttgcccaaccacagagggcatcatctacattctgctgggatccataccagaggaggacagaaacagaaaataggatcgggactggaaactagagctgtggttgtcttctggatggatcagaatgctctagatcaatggaacgtggcagctccaattccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaa

SEQ ID NO: 337941 - DNA, 841 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaa

SEQ ID NO: 337942 - DNA, 590 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaa

SEQ ID NO: 337943 - DNA, 868 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaa

SEQ ID NO: 337944 - DNA, 894 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcaggaggtgcttttaatgtgctgataaaccaacctcaggaaggtattatgtacagaagattcccaaggctgctgttgctgaaagagacttgggctactgccagggaactagaaacgtgctgagaagaggactgcaatgactgctttcaaaaaacaccagaataaatacatacgtagtgtaagcaagcga

SEQ ID NO: 337945 - DNA, 616 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagatccagtttccatcaaagggacctctcttgtcaccaaaatttaaaaaaagaaa

SEQ ID NO: 337946 - DNA, 272 bp, Homo sapiens
gcctggccaggcgcctggcaaaaggcattacagcctgaggtgtgtggctgaaagaaggagtgggtgcaaggaatggaagaaatttgaatcctaaataatttatttctccacggaaggatcacagctgctgaagcctcacctgtgaggctgtgaaactggaaagccaccaggattccaggtcacacggggtattgtctaagctgattggctctgtccttgtttttcttacagatccagtttccatcaaagggacctctcttgtcaccaaaatt

SEQ ID NO: 337947 - DNA, 328 bp, Homo sapiens
cattctagctgatgtcctgttggccacaccctgagttaacacagaattatataccggaagggatagttcactggggctactaatgtaacaacctaccattgtctgccctctgactcttaataattcatatctgcttgcaaaatagggtcatccctaaaggcaaaaacagaacttccaaagtatctttctgtgacaacattaggttcaggcttgaagtccctgatttcgccatcaaagtcagatccaggggggacgatgctattcaggtaaggttccccaagtgttgttcctaggagcagagacctatgaactaaaaagaccagttatc

SEQ ID NO: 337948 - DNA, 1075 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcga

SEQ ID NO: 337949 - DNA, 696 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaa

SEQ ID NO: 337950 - DNA, 123 bp, Homo sapiens
gccacaaccgtaaccagcaaaacaaaggtctcaggcagataccaagacacaagaaagggtgctggcagcagagcaggcagtaagctgggtccaggagggcagaagaaaagacaggagactaag

SEQ ID NO: 337951 - DNA, 343 bp, Homo sapiens
ctgtagtcccagctacttgggaggctgaggcagaagaatcgcttgaacccgggaggcagaggttgcagtgagccaagattgcgccactgcactccagtctgggcgacagagtgagactctgtgtacaaaacaaaaacaaaaacaaaaaaaacccagaattttatagacaattgcagaagggttcccagggcacacctatagccatggccttggaccctagggtaataacagccaaggccatgtggagacactatgcagaggagatgcaaagggcagttaagaggatgcctggttagctgtgtttcagggagaaggaagagactgccaagtgaacatgatggag

SEQ ID NO: 337952 - DNA, 3948 bp, Homo sapiens
ggcgagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctaccta

SEQ ID NO: 337953 - DNA, 4133 bp, Homo sapiens
ggcgagtgggggaggggcgggcggggggcggcggttgggcagcgtcgcttcttaggaggaggaggaagaggaggaaggagggcgagcgaggaggatggcggagtcggggctcctgacgcattgtttacaataaccaagatatgaaatcaacctatgtcttcattgatggaagaatacacacagaaaatgtgacgttcagccttcaaatctaggaaatcctgatattggtgacatgatctgatcttggcccactgcaacctctgcctcccaggttcaagcgatcctcccacctcagcctcccaggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctaccta

SEQ ID NO: 337954 - DNA, 3894 bp, Homo sapiens
ggcgagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacgatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctaccta

SEQ ID NO: 337955 - DNA, 2873 bp, Homo sapiens
ggcgagtgggggaggggcgggcggggggcggcggttgggcagcgtcgcttcttaggaggaggaggaagaggaggaaggagggcgagcgaggaggatggcggagtcggggctcctgacggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctaccta

SEQ ID NO: 337956 - DNA, 1350 bp, Homo sapiens
ggcgagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggtatgagaggagaaaggagatattgatagctgttaatagctaactggatattaataggactatttttgatccatttggtaatgaaaattcaggagtaaaattcacaattaccaaagttgtaaaacttttaagataatattttaaaatcatttttcat

SEQ ID NO: 337957 - DNA, 1094 bp, Homo sapiens
  misc_feature (835)..(835): n is a, c, g, or t
ggcgagtgggggaggggcgggcggggggcggcggttgggcagcgtcgcttcttaggaggaggaggaagaggaggaaggagggcgagcgaggaggatggcggagtcggggctcctgacggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaaccttngaagaacctgtatttggaaatggacaagcccaaacctggattagctttccactattgaagcctgggactcctgagaggaaagcgttttcaaaccagtgaagtagtgacgacaactgtgccacatcatagtaataccttccaacagccagaatatgctgagcaggggaggcgcacattcatatcatacagagagttaaaaagatagacgggggccaaatcgaggacaaggggctggagtaaaacatgcggggccacacaa

SEQ ID NO: 337958 - DNA, 572 bp, Homo sapiens
  misc_feature (419)..(419): n is a, c, g, or t
  misc_feature (445)..(445): n is a, c, g, or t
  misc_feature (510)..(510): n is a, c, g, or t
  misc_feature (536)..(536): n is a, c, g, or t
ggcgagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagaaaaanaaaaaaaaaaaaaaaaaagcggccgncgatcctgcagccggggtccctattctaagcggcgcaccgcgtggagctccacttgtccttaggnggtaatcgacttgcgaacaggcaagngttccgggaatgtatcgccacatccccaccggcggc

SEQ ID NO: 337959 - DNA, 3974 bp, Homo sapiens
agccggcgcgagggcgcgggccgggggcccccggcggacagtctctctcctctcggctccctgggcccccgggcccagtccgcagggcgccccgagtcgtgtaaatcgttggcgagggcccgggcgcagcggcggtcatacagggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctaccta

SEQ ID NO: 337960 - DNA, 5312 bp, Homo sapiens
  misc_feature (3954)..(3954): n is a, c, g, or t
  misc_feature (4206)..(4206): n is a, c, g, or t
ggcgagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctaaaaaanaaaaaaaaaaaaaaaaaaacttggtgtgcggcgcgcgcgcccaggggccaccagagaaaaaggtcttctataagagaacccatccgcggttgaggcgcgcgcgggggggccccacagtaagtgcaaacgagcaaaccactgggcgccaaaacggggtggtcccaaaggagaacactccggggcgcaatagcgaacaacgggcgcgggcggtccccccaccaaataaaaaaaaagagcgccgcggggaggcancaaccaagcggcgtcggttccggagaaacaaatccccgagaaggcgggcgcacgaagggggaacaaaacgggggactacaatcaccaacgagagacgtcccaagggaggagccaggaatataaaaatataacgcccggcagcagagggggagcacaaccatcacagcaacaacaagcagaacgcaagagcagaggacgcggcgaaggcgagacaggagcagagaggggagagagcaaaaagcggacaagaaacgaagggcagaagaaggagggaagcgagccagagaggaaggcagaggcgagacaccgacgaggacaacccagacgagagacgagagaaaggagacagagcacaagcgaacaaccgcggcaaagagaagcgagagagagcagagaaggacgagcagaggaggagagcagaagcagagagggggagcgagaagcgcaagcagaagccaaaaaagcaagacgcaaccacaatagcagaacaacagcacaagaaccgacagacaacaagaagacacaaaaagaaagagacgaaacccagccagacgaaccacacacaaggagcaagacagacaagaagacagtcagcccgacgatacgcgagagagagcaaagacacagaaacgacaaagcaagaacagagaacagcagagcaaaacaaagaagagacacaaaacaacagaaagaagaaccaccgacacaaaccaagagagacgaccagcaagacaaacctaaaagcgcgagacacacgagcgaagaccacacgaagcagaaagcggaccagaccacgagaccacagaagcagcagacaccgaggcagcggcagacgagcgacgggagaagagcagacagagacaaagacaaggaagaagcaagacgaacagaagaagcaaacgcagagaaagaacagcaacaaaagaaggaagacgagaggacacgcgacagcaaactaggcaaagcaagacagcgaaggaagcagacagcagaaaagcaaccagagaaagacgaacagacacagagaagaagcgagaagcagacgaggaaccagagaagcacagagaagagcgaaacaagaaacacacagagaaaacaaccgacac

SEQ ID NO: 337961 - DNA, 4005 bp, Homo sapiens
ggcgagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaatgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctaaaaatacaacaaaaaagtcgaccgccgccgaatttagcagtagtagtagtagtaggc

SEQ ID NO: 337962 - DNA, 306 bp, Homo sapiens
ttctggccaatggatgtaagcaaaatattgtatgcaccttccaggaagtgttcttaaactgaagggtcatgcactttctcagtccttcctgctccctttggaaaacactggaaggcctatttctccataaaattctaggaatctccaaggaatgcttgtattttctaaaattcatattggtagtcacttgtcctgttcgccaagtgccctcactcaaggccattcaagctccagagctctgcagatccttcttgcaacctgacaaacagactatcagagctctgtgtctcctctgctcttttgtct

SEQ ID NO: 337963 - DNA, 451 bp, Homo sapiens
cctcaggtcactttttccctaattatagcctactgcattgctatgtgcatttcctcattctaacaccgcataatgaggtagaagccccatattgtggcaagttggggctctcttaaatttactgacttagtagactataccttaatcatatgggatatttctaaccttgcaaaatttatataattacactttcttttttttgagacggagtcttgctctgttgcccagggtgcagtgtagtagtgtggtcttggcttactgcaacctctgcctcctggttcaagcgattctcctgcctcagcctcccaagtatctgggattacaggcatgtgacaccaggcccggctaatttttgtacttttagtggagacgaggtttcactatgttggccaggctggtctcgaactcctgacctcaggtgatctgcccaccttggcctcccaaagtgctg

SEQ ID NO: 337964 - DNA, 107 bp, Homo sapiens
tctacctggcaaaggtcattttgaattgtcaagagtatattggagaccccttaaccactgaattccattctcaccaagacccctcaatatctttcacaggctcctct

SEQ ID NO: 337965 - DNA, 205 bp, Homo sapiens
ttcagattagtcttcctaaaacgtgtttaattgggtttaaaacacagtttaaattcctctgttttaaaacatttgtttcttcccagttgcctacagaaaagatctcaaattcctcagtctgacagtttgcctggacaagacctatctcgtcttactccagttatttttatttttataaggaccatctgctactatcaaaaggaat

SEQ ID NO: 337966 - DNA, 192 bp, Homo sapiens
tcagtagggaaagttatccggacccagttaccatttagcataaacctgagatgaattgtattatatttttttcacaaggcaaaagtcctgtgaaattgaaagtgtgacataacacaaatgtaattgaaccatgagtaaccagaagctaactaattagagcttcagttgtctggaaatatttttatagttcgt

SEQ ID NO: 337967 - DNA, 599 bp, Homo sapiens
tgtaatttgaccagaaacaacggctggactttgggccaaatatcagtcgcacttaacttaatattgcttggcataaaatgtagtttgcagtgttctgaaccaatccattggaacttcaagtcctgtcagctctatttttctagatacatcttggatccctcctcctgtctgcacattagttcaactctctgttccaagcactattcttgtcactgggaatataatgatgaaaaagacagacaaggctaccgtccttatcgtttattgcttcaactatggcaaaactcctgatttgtttcactctatctagtttctccattctattttaacactgtggccagactgatatttttcccagactacaaaaatgatggcgtcattctcccaattatattccacaaaatccctcaatattaacccttacctatatataccaatatcaatccctacccactcttccctaccagagccatgcttaatctcttgtcactttctgaacatacaacttcagctttcttgcctttgcacatgtcctttctgccagaatatatctttcccatctcaccctagaaaaaaaaatcccttgttatggttcaacg

SEQ ID NO: 337968 - DNA, 385 bp, Homo sapiens
acccatttctaagggatgcctaatgccctcctgactcagtcccctcctgatggccatacctctcaatactgttgcattggggatcacatttcaacaagaattttggaagggacaaaagcattcaaaccgtagcagtatgtctgtaccacattttgtttatccattcattcctcagtagacccaggggttgcttccacactagggctttctttcagttttaaaactgggatggtcttgggcaaactaggacaagatggttttattctggtaccaaactgcagcctctgtttggagttggccaagttactactttcaaaaaagttcccagtgggtaggggttgaccagaagcttagaaaatctatgcatcagttttggtgcaatatc

SEQ ID NO: 337969 - DNA, 293 bp, Homo sapiens
tcctgttggtcctctttgtgggatagtccctcatcattttcttcctgagcttttctttactatgtgcttttatttactatttgtgtgtgtgtatgaatacaaatttataagaacttatttttaaagaatcgtatggaaaatttcaaatgtataaaaaagtagagagtagaatgataaattcctgtaatacctatcacccggattcaataattactaattttgggccagttcaataattgttcttgttttctgactgatttttttttttttttaaagagacaggggtcttgcca

SEQ ID NO: 337970 - DNA, 100 bp, Homo sapiens
ccatcatgctcagctgagtgatcacattctttagaagactaggtcatttctgaataacacctgacccttaccagatgagaataggaggagagagtgtttg

SEQ ID NO: 337971 - DNA, 623 bp, Homo sapiens
atcattacatagactaagtggcttataaacaccataaatgtatatcgcacagttctggaggcttgaagacgaagatcagggtaccaacgtgatcagattctggtgagggccctcttttaggttgaaaacaaacaactaccccttgtaacctcacatgaaggaaaggcagggagctagctctctgctctattcctataagggcacttaatcccattcatgagggctcaatccacatgactcaatcacctcccaaatgcctcacttcctaataatttcacattgagggtatggaatgaattgtaaacaggccttatctttcaaagcatccagcagccctgagttccacgactctttatacctgaggtgagagttggccagatagggaattgatcctatgtcctactgaaaaccagtgttggtattagcaatggtcttggtaaaatacaatgaagaagaataacgattttaaaatgaaaaaaaaaacttgaaagaaatggaaaattataaaggacacagttgcaggctcaatataacttaaattaggggttgacagactttctctgtaaaaggagtggagtttgactgaatgtttgtctcccctacaaattcatatgttaaaatct

SEQ ID NO: 337972 - DNA, 312 bp, Homo sapiens
ggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatata

SEQ ID NO: 337973 - DNA, 969 bp, Homo sapiens
tcctctgtgggagggttgctggtctctgttaaaagccccccgggtgacgtgcatgctgccagggcctgtgcccccggtagacattctggggaggggccaccacaaggaaacctcagtccaagctgtccagcggaggctgggcatggctgtgccagcacaggaaggcaggtaggggtctctggggcaggcagctctccccctggcccagccccctgtgtgaagtgctcagcctgggtaggaacgtgcttcccactcagcctcctccaagccgctggaggtcccactggttccccaaatggcttctgtcctgagccgtgggctcctgaccacgcatctaccttgcacggtctgaacaagagtctgcgccagggaccccgatcgggaggggcacagaggaagccaagggcccacacaggtgagggggtctcgggtctgagcctcacccagcccaggctcagcagcagcctcagaatttcctggcatctgcttgcctgtgttgcaacccaagtgggatgtgcacgccgcctgagagagaaaacactcggggaggattatgtaagcgctttcctccccagcacagggccgtcctgggcacattgaggccagaccatgtgcaaaagcactcgggagagtggcaggagctgagccaccagagggggattaaccccttccgggatgctggcagcttgtcctggggaacatggggctggtcaggattgcaggacacggaggggcggagtgtgaatgtggaggcaccggtgctgcgtgattttccacaagttgtctaacctctctgtgccttcattgcctgactcggctgtttccaatgcaactgattttaacggcacctgtttcatgaggccacagccaggattctgggaggcaaagcacagaaagccctcaatgcggtttcaggctccaggcaaggctcagctgacagtagctgaaaacagcaatttcagccgcaga

SEQ ID NO: 337974 - DNA, 325 bp, Homo sapiens
caaggtcttctgtctgaatttatctgaccactccttctgtctcatctctcttcttcctgcctcttctgtgctggaggcctcatgtgattacgttgggctcacccagataacccaggataatctccctaaaatcatttgataagtgatcttaattcatttgcaaaaactcctcacagcagtacctagattggtgtttgtgtaaccatgggtagggatattaaacttcagtattctgcccaccccagaagcctttctcaagtgtctagtaatcattggctggctgttcctatgtttaatgctggggctttttttttttttttttttt

SEQ ID NO: 337975 - DNA, 552 bp, Homo sapiens
ctctatcatgatgtatattaaagtgaccagcacagtaccttactctagcggttaatgcctcaatttcatgaccaaatctggaactgcaagtgcgtagcctagtcagcaagaactactgattggacaaaaattagttatgttaaaaattctagagaaaggcagaaatttgtgggggagttgtgggaagtggcaagagtttcttcacttttgattagagttttgcatgcatgataacaaatgtcagggtaacactctcaagactaggtaataatatcatcatataaacacccaaaactttgggcaaaacagaccacctcagatctatcagtggacactgctgatattactgtgcatcctggaatcatgaagctggggacctggggtagcagtgtatgctgacaaggtttctgtttctacatttattattatttctctactggtgagtactgcagacttcttacagccatgattcaaaccttaacacctgagtcagctagaactaaataacatgcagaatttgagctcaattcgtctcatgggggtgaaatagct

SEQ ID NO: 337976 - DNA, 177 bp, Homo sapiens
ctgtattcccacctaacttgggaggctgaggcaagagggtcacttgagttcagtttcattgcactctaggcaacatgatgaaaccctgttcctaaaatataaaataaaaatcaattttgtacactggatgggatctgtgaaaaataagtacattttaaaaatattaatctatagcta

SEQ ID NO: 337977 - DNA, 300 bp, Homo sapiens
ttcgccttccttctcctttttgattaatatttataattagaattgatcaaaaatacgggtcatgttcacagactagaaccacgcccgtgaggatagctctgtgaccgggccatggggaacacacacagacagcagcttccccagaatcccccgagggcccacagccccgacctggctctttcctccctgattttcccccaaagggtgcaacaattcctgttttcccagctctgcaatctttcccatctatcaaatgggagttaagatgcaattacttatttatgaatgaaattagaagag

SEQ ID NO: 337978 - DNA, 180 bp, Homo sapiens
tgtcacagttttcaccatctaacaaataaaatagcttgtatacagcagagtcacagtcaacctgacataaaaggaaatgtcaatgaaaagtaaacctttgtatgtgttgctgctaagattttggggcttttgttactgtagcataacctagcgaaagctcagcgagacagcctgtagaat

SEQ ID NO: 337979 - DNA, 349 bp, Homo sapiens
aaagcttcataacactggatttggcaatgatttattagatatgatgcccaaatcacaagcaacaagcaaaaaaatacagcatcaaaagatactactgatagagtgaaaagaaccagcgggcatgatggctcaggcctgtcatcccagtgctttgggaggccgaggcaggtcctagtttgagaagttgcaagtagcaagagagatcagatggttactgtgtctgtgcagaaagaagtagacataggagactccattgtgttatgtactaagaaaaattcttcggccttgagattctgttaatctataaccttacccccaaccctgtgctattgacacttctaaaactagg

SEQ ID NO: 337980 - DNA, 488 bp, Homo sapiens
agtaatcagagaaagccgcatgaagaataaattaataagtatttattgaatgtctaccatgaaccagggagtaggtgatgtgctgagaagacaaagatattgtccttgtctctctatgatcttactgttaaatggaggaaacatattggcaaactgacagttactgtctattgtagggagggctatcatatagataaatgctgatgctgtggtagtgaagaggagtacccagtatagccagagtgagaaagtgtccaggaaggcatccaagagtaagtgaaacctgaactgttacctaaaggatgtgggaccctgagcaaaaagtttggggaaagagcattctgggcagcatgaacagaagtaaggggatgagcaagcttgagagggggaatattgggcattgataaggttggagcataggatgtgagggaaggagagatgagatgagatagggagagggggcagggactgcttcagttgtcgactgg

SEQ ID NO: 337981 - DNA, 204 bp, Homo sapiens
aaaaacaaaaaacaaaccaacaaaaaaacctactttctagggttgctaggaaccagtagctatccaaaaggaaatgccagatttatagcttccttttccttcggcattagtgctaagatatccttactggctcttactctcgccatctcaaccatcagtcatgcatttaaaaggatattttctatctgtctatccatctatcaa

SEQ ID NO: 337982 - DNA, 136 bp, Homo sapiens
cagtttacattttattctaatcacaatgagaattcattagaaagttttaaacaagaagagtaatatctaatttaagtttttaaaagattgttctggccaggcacaggggctcatgcctgtaatcccggtactttgg

SEQ ID NO: 337983 - DNA, 500 bp, Homo sapiens
acagttcccttcataaagacagtacatgactggctattcttagataaaaaccagcaaaaacatggggacagccactaagcatcccaggttttctagggcatttaaaaaactttgtcctaacttccccacggtgaaagatatgcctctcatttgaggcctgctagttgaggatgcccgctgtagtggacactgtcggtgccggaccccgccccctttaccatgcttctgtacccattcccctgtgtgctgggatcatctgcacctgcccccatctccagaaaagtggccaaatgggaactgcttctcccaggagactatgacatcttaacgccaacagcccaccttgcagcagacctcaccactgcttgactggcacaggggtgctaaaggccaccctgctggctgtgcagtgaagctgcgctccagggctccctgtggaatcagcctgaagcgagtctccagccgaggctacatccatgctcagccccttcccttgcaat

SEQ ID NO: 337984 - DNA, 386 bp, Homo sapiens
gagtgggttgatatggaacagtgggctgactagtgggggcagggcagccttcgagttacaagtgaatcccaaggccttggaacaggcagcaacctgtggggtatgtgaagcccagaggggtatgtttgggagggagatcgtgagtgtgtgtgaaaaggggtgctgtctctaaggattggagcatgggagtgcgagacccaagttaagagtcccgagatcgcagagttaagagacctgagaactggtggtggagtgggagggcaaggcgcgatggactaggaggaggcactggtgggttggaggcgcctccgactggagcaactggaacaagagggctggtgagggcgccgcgagacccagggcagggtgcacagaccaggtaggcg

SEQ ID NO: 337985 - DNA, 375 bp, Homo sapiens
aaaactttgtgcatattcattaagcaatttctctatgtcaggcattgctccagatattggtgatacatcaattaaaaagatgctaatctctgcactggtgaagattttattttatctagaagttaaagacttccagagatttttttcattatatatgtgtatgatatttagtcataaaacattctgtaaaactccacaaaataaatgttctcaatctcagggtctcctcttctactatttgggttaatagactaataattttttctttttcttttttcaatcttaggaagatatttttccctcaatgtttaccatccttttaaaactgtagaaggttaattatacccatctccccatagcctatgttgaaacatg

SEQ ID NO: 337986 - DNA, 268 bp, Homo sapiens
gcaaattcgtgatttaacttaagggcaaagagaaggaatagttttcaggacatcatgggggaaatatagatagtcaagagaaaagatttctgtaccctcatttttctttccctgttctctaagctaccccctgatgccctaaggatgaaaagctagagctgctgggattggtacttttggaccgtgattaattgtctagtgaatcctgtcttgggagagcctatcctaaattcaccactgactttttctactcttacagcctacctgg

SEQ ID NO: 337987 - DNA, 328 bp, Homo sapiens
accgagaaaaagtaaaaatgttacgaaagactatatagaggctattcactatactaatagcatgatctcatttttataaaaacccaaaactatactgcatatatgcatatatctttcctaaagaagattaacgaggacacacaattttctatatatatcttttattttacactagcatcactttttgtttttattaaagagaattttaaagagaccagatatacacatatatatctgtttcgataacacaaagcaccttctaggcacacaatatttagaaaagaaattctctgcgtattgtttcttgggaaggtaggaagggtgagca

SEQ ID NO: 337988 - DNA, 227 bp, Homo sapiens
gttagctgtggacttttaatatatggactttattgtgttgaggtaagttccatctatgcctattttgctgagcattttaattataagtgaatgttaaataatgctctttctgcatctattgagatgattatgtgtgtttttttcctttcattttgttattgtgttgtatcacattgattgtttgagtatactcaaacaatcaatgtgatacaacacaataacaaaat

SEQ ID NO: 337989 - DNA, 392 bp, Homo sapiens
acaacagttcatcaaggacatatgtataaaggttataaaccatattgttgatatgaattctagaataggattgcactgttatccctggggaaacttgtgttgatctaagtttgggtcagttaatgatactggtatattctgactggctaagtctaagttaaatcattccagagttttttttgtgtgtgtgctctcaggtctccccaactaaaaattattattcattcacttttgagttattggtaactaatttccataccaattttgttgaccagaatgcacaagagtaagaggatgagtgtattggtgcaggcttgagggggccaccattggatcttggcaggaaaggaaagaatatgaagctagaggttgggtgatggtaggggaagagc

SEQ ID NO: 337990 - DNA, 445 bp, Homo sapiens
tgcttctggcatatacgtgcaaaatctggcagctcctttttggttacatgcttggcaaccccatagccagcggggtggcaaggagtggtggcaccagggagatctcaatggctgttccagctgtaacctcaggttggggtcaggagtgggattctggtgtgtgggagggacctgctaagaacctgtcagagccctcagccttggaggagctatagtgcagacaggttgccacagcagaaacctagggatcagaaatagcagcagctcgcccatcagaactgcatcctggctaggctggccacaacatgacataaggtcaagccagcctgccagcgtagaggttctgcacagggagagggctacctccctgaagagcatctctttaggagcactacagtatcccaagaagtttcattgacccttgtattcatttcctagggctgcc

SEQ ID NO: 337991 - DNA, 171 bp, Homo sapiens
gaatgtttcagatgttcatttacttcagaaactttcaggtactaaatacggggtagctgggaaagggcatcatctgagttagacatgagactcggcttcagcccacactgctaaggagatgactcaatgtgaaagccttgtggcctgcagctgtgtgattgtcccagggcc

SEQ ID NO: 337992 - DNA, 298 bp, Homo sapiens
ctcacaggtgagggaaattggagcgagctgggctgcactgcagcaccctagcctgttctgaagtgctctggtattaagtgatcccaggtggagctgaggttaaaaaactttgtgtactgggggaatcttggaagaacacccagggcacacacggttttcccacttgagtatacagagcccaaatacatttctaaaagttacctaaagctttcttatctgaaacatcccatttaccctgagttgttttgagcattagaactaggagatgagtcaacaatgtggcaaaaatcagcctgct

SEQ ID NO: 337993 - DNA, 518 bp, Homo sapiens
ccctctccacctccgagccctgacctcctcctcctcctccttactcctcacttcatcctcacagtggtatcttaggtgctcaagccgtcccccatcctgtgagcttctgagcctgggcctcactccttactccacacccccagaggactggcccacaatctttgagggtgttccaggactaagtttggaaaaggacatgataaaaatgaaaggaatgagagaagaaggaagggagaaacagaccaacagacagagagagagagggcgagggaaggctctgcctcaagccaacccagcctcagtcgtggtatacttccccgaattccttcccgcagcaccactctgtgcttagaaccaagagctaggagagcaagggagcctgggactggcacttttcagctagggggagctggtggtggcagggcagagaggcccattgcgcagctggtaacaggctgtgcctggccaggcctcccagctgcccctctgtctcaggcccttattgcacacaacatcca

SEQ ID NO: 337994 - DNA, 1093 bp, Homo sapiens
ggaaatctgaatcctgaccagttgttcctgtatgtgcagcatccagttctctccgagacaaggtactcctggagtcctcttgaaatgccagtttctcttgccttgcaccacaatccagtagattagatgccttcacgtccagcacaccttctgcaagcttattactacagtccgtgtagacgatgtctaccataccttctgtggactcatcacaaccagacatcttgacaaaggctcctttcaaattgcatttctttggactaccacaaggtagtgagttattactgcctgagctgaccagcagatccttttggttgtggtttacctccccgtgaggctcggtgacagtctctctctggtcactacttagcatctccttggctgactgaccttcacttttgcattcatctggtctgttttggttactctgacagtcaaggacttcatctgccttctgatcgagtgtttcaactgattttacatttttaaaactggagaacataacagtaggagactggtccaacactttttcaggacctggaatgtttacagtctggtttagttcttgtatagcatgatcagagatgttatacttacaaaatacagtttctttggatacatcctgctcctttccttccagcccttcctcactgagtttgatgctactggaggtgtgaatggttttgtttgaaattccactatttaacaagcctgctaccattttgtttctgatcttatctcctggaaggctgccattcgtttctttcccatcaagttccctttcctgtgatgtgtaactcactttacagctgcttttttccacagagtgtcctgttccttggcagcagtgatcacggtgctgaaatgcattttcatattttgttatcaaagagttatcaacttgcaggctgattttgctggacttgaaagcagcagaagcagaacacatgttttcctgggatacattttttcttacacgatgacagctagagatatcctgagattgaacgctgtgacattctatgacagagaccacttgaggaaagccagctgcttctctcttatttgagcgcagcctggaatgtagagcttt

SEQ ID NO: 337995 - DNA, 433 bp, Homo sapiens
gtctgcatgcacgtgtcttctctggtggtgtctgcttcaaatattctgcccgtcttttcacatggattttttttcttactgctgagttttaaggttcctttgtgtatctcagagacaagtcctttctcaggcatgtctcctagtctgtggcttgtcttctcattcccttaacggtgtcttctgagagcagagtttcgaacgttttgatgaagtctagttcatccattttttccactataggccatgttttgttgccatttctaagaaatcttcgcctaaccccaggtcacagagatcttctctttggtgttcttctagaagttttagtttcataattaggaccgtcatctattttgagttagttttgtatatagtgtgcagtatagaccaaagtgcattttaatttgcacagggatcaccagttgctccagct

SEQ ID NO: 337996 - DNA, 379 bp, Homo sapiens
gggtgcctccccgggtgcctccccgggtgcctccgttaccaccaaaacctccagcgccacggtttctagtcatgccacctctgtttacgctctgtgcaggtgtctgttatgtatcaatctgtgatgtgacaagctgaatgttcacagggcggccagccagaggggtgccgtagtactgcttcatggccttcagggcgtgtgccttccgctcaaagcgcatgtctgctgatcctaagctgcggccagagccatcgtagtgcacagccgccttcttcagcgttccaaattctgcagagttcccaaatatcagtgtctgatacttcaaaacctagattggacaccagcagtttcccacccgtctccacgccggcaccactgc

SEQ ID NO: 337997 - DNA, 415 bp, Homo sapiens
ggggctggagacggggcaggggccagtctacagggtggaaagagcccccattctgactgtggaagtgacccccagactgctcggtggacttaatggaactgctcaggctaaaaggcatccctttctcctgggatctgcttccttgacccttcaggagtctgatttggtggtttcctttgcctctcagccccgctattcatatggaggagaaaaagggagagaagagctgtgaatcttgtctgtttaccatggttaggagaagacaaaaaaaatcatctctcccctggccctacctttagtcaggattccacctagaagccttcagagcatgggaatccattgagctcaaagatcctgtgatagggaggattcaggaggttctccttgaggaccccgaactttctatttctgcgtg

SEQ ID NO: 337998 - DNA, 378 bp, Homo sapiens
gctctcatcccaaaccctacaaatcatcaaactgggactcagctgtgactgactggctgttctctggactttttaagtgtctgtctcacattatgtaactccagtacaggagctgctctctctcccagcccatttcagttgtcaattcttccatgttcataggactcctttgtgatcaggatatctggagtgaggagccaggggaatattcctggttggcaaggaaaagagggccttaaacataaatcccagaaggacactgttgatcacttatgcacaggggtctgttaataagcaaagagtggctatggacaagaggatttcctcaaagcaccccacagggaaggaccttgacaatttgtagtcatacttgaaaga

SEQ ID NO: 337999 - DNA, 109 bp, Homo sapiens
cactggtctggcctcctttggccacagctgcaccacacttccaccttctctccagtggtgagacctccttgcccttcagaacagtcagagaaaactagaagcctgccca

SEQ ID NO: 338000 - DNA, 341 bp, Homo sapiens
ccagcgtctgtaacagaggaagttaggcagtatgagggaaaaaaaaaatcaatcacgggagagagcggaagagatctaccaccttatccatcttcttgactgtacagtctccagagcatttccattaatgggcaagaaacatcccagtgcattgtacacctgttatttgtaaactcttgtgacatgaataatgctttcctcacaatctgttctactgaactttacttttttctaatagttctgccaagtttgagatctgcaattttagctaccatgatgttccactgctttttctacctacacagtcccacacagactgtgctgaaaatcaagaagaaaca

SEQ ID NO: 338001 - DNA, 437 bp, Homo sapiens
ctcgcgaacgtatatccaagtatctacctcacgggattactgtgaatattaaatgaggtgatacttgggaaaacacataggaagggcttagtaattgcttattattattactgatcccttacattgccataatgtggagccaggtacatagtaggtaatcactgaatctttgtcaactagttgcagggttgttgctaaggatgtcaggttttgacttgaaagtacacctgtatttaaagagtggggtcatctgaggtaactccaagactagaaaaacatttctaatcctcaatcctgtaaaacacttcaaaatggcatttgttcacctctaagatctaccctagctctaatagtccatgaaatcatgatgctgaattacataaaacaaggggattaatgtgaacaatacagaaaaaatgttgaccaatagcatggat

SEQ ID NO: 338002 - DNA, 386 bp, Homo sapiens
tctatcacctatgctggagtgcagtggtccaaacacggctcactgcggcctcaacctcccaggctcaagcagtcctcctgtctcagtcttccaagtagctgggtccacaagtgtgcgcctggctaatttttaaaatattttttgtagagatggggtctcaccatgttgcccatgctggtctcaaactcctggcctcaagcatttctcctgcctctcgaagtgtcgggataataggtgtgagccactgcacctggccacacatgagtttttgagcaataggaaatatatatacatatatgtataaacatgtatacacacacacatacataaaactaaaactgtgtatctcagattttccatctaaaactggtctggactagggatct

SEQ ID NO: 338003 - DNA, 338 bp, Homo sapiens
aaaaacactaaaaatcttcatatcctttgccctattaagtcctctttggagaatttctaataatctcaaatgcagtttttaaaaaactttattcacaaaaataatggtgactaagctcaacataaaattattactaatagcagatgcttggaagcaacctaaaaagtttaatgctgcagaaatgatataaattattttctgctcacataccagaaattttaattacatggaaaaatgcagactacaatgtgaaatgaaaaagaaaattcaaaattacagatttggtatgatctcttatctaattgatatacatgaaatcttaagactgaaaggaaata

SEQ ID NO: 338004 - DNA, 354 bp, Homo sapiens
ctgctccatgaaagcccattttggatgccctcacccccggaaacacaggctctctgaggacagtctgtgtcctgaatatatctctgcagcctccagggatgcccagtgccaggcacaaggcaagagctcattaaacgtgtgccaagtcactggatgccctcctctgaacacattaacatttctgaaagccccaagcactgtctagacatctctctggggccactcatcttgccttgaatcataattctgcctgcccttcttagtagggagctcctcagagggggctcccagggcccataccccacgtgtgccccagccctgtagcccacttggctcaggaatcacaaacgcaaa

SEQ ID NO: 338005 - DNA, 597 bp, Homo sapiens
cagcctcagcctcctgggctccagcagtcctcccacctcagcctccggaatagctggaacatgccatcacgcctggctactttgtgtcatttttttgtaaaaataggattttcccatgttgcccagactggtctgaaacttttggactcaagcagtcctctcacctcggcctcccaagtgctgggattgtagacatgagccgctacacctggcccagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggtcaggtcatgtccttcccctgctcaaaaccctacagtgctttcccaggacaagcccaagtctttaaatggcctaccaggccccacacaatcgggcccttggctacctccagatctcatcaccaccagtctcctcacattcactggacttcagccacactggcatttttcctgttcctggagcacctcaagcgtgttcctgcctctgggcctttgcacttgttccca

SEQ ID NO: 338006 - DNA, 296 bp, Homo sapiens
agactctggacctaactgaggttaagtaacttgcctgccttcagaactggaattaaacccaggtctgtgactgcaaaggctctgcttttctttttcccctcagaaatacacaaagacggcacccacttctgcacacccatggctgaccctgcagctgtgtgtacacatgcaactgacttcaatgtctatcatcactagttttcatggtcacaggtgtgcatgccataagcctcaacccccacagccatatgaggtgaccctgacttccaccatggccatcactactgtacatggac

SEQ ID NO: 338007 - DNA, 701 bp, Homo sapiens
tactggtataataataggcgcatagaccaatggaacagaatagagaacccagaaataaacccaaacacagccaactgatcttcgagaaagcaaacaaaaacataaagtggggaaaggacacccttttcaacaaatagtgctgggataactggctagccacatgtaagagaatgaaactggatcctcatctctcaccttatacaaaaatcaactcaagatggattaaagacttaaatctaagacctgaaactgtacaaattctagaagataacattagaaaaacccttctagacattggcttaggcaaggatttcatgaccagtgtgtgtctgtagtttgagctactcagaaagccgaggcaggaagattgcttgagcctaggaggggaggctgcagtgaggtatgatcggaccactgcactccagcgtgggcgacagagcaaaactctgtctccaaaaacaaaaacaaaaacaaggccaggcgtggtggctcacacctgtaatcccagcactttgggaggccgaggtgggtggatcacctgcggtcaggagttcgagaccagcctggccaacatggtgaaaccccatatctactaaaaatacaaaaattagccgggcatggtggcaggcgcctgtaatcccagctactcactcactgtctggatactatagctgaaactggcccattctggcactgtttgg

SEQ ID NO: 338008 - DNA, 287 bp, Homo sapiens
ttcttcctcgttagaaattttggtggttgttttgtcaatagcttactattgtaagtagtatttgcatgaacatctttatgaacaaattccccccatatttctgatcatttacttggatacatgaacaggcttattttaagttacctattattgtacagcaactgtttctgtacttagtaacacatatttaataagtattaatactgtgcaaggcattgatggagaaatgattgagcttgatccttgccttctctagtagctcagcttctagctggggaataagatag

SEQ ID NO: 338009 - DNA, 998 bp, Homo sapiens
tgagtcatgagggcctccctcacggatgggattagtgcccttataaaagggctggaggaaactagctaggccacttttgccctcccgccccttccactaagtgaggccagaacgtagcaaccagacaccatcttggaagcagagagcattctcatcagtcgccagacctgctggtgctgtgatcttgaacttccaacctccagaattgtaagcaatgtatttgtgctgtttataaattacccagtctaagggattttgttagcagcataaacagaccaagacactctctctcagtttcttggctctctctccgttggcctcattttctcctgcaaatgaacctcgtccatttggccagcaggagggaggatgtggctgcaggccaccaggctaacagcccctcaggtcaacaacacccccatggaacctcttcctctcttcagcgtgtgtcatacgtgtacacacatgcatacacacatacaggaagcactctatctttacatagtgaagcttgtggtcatcattttatttcctcgtgagctgcaatggtaagaattccctgaaaattcccccactggcaggccacagcgtgcttaaacaacatcaaatccaacgcatctcactgtatcactgaactatagttagaggttttgttttgaaaattagttgacaacttcagcgcttttgtcatttttatgttcaccagcacaaagatgagcttttaggtgctcaggaagggcaagccaggtgaccgtcttccatgcagcagggactctacttaaattcagtgtttttccaaagcccctttctactccaaaagcacccatcttataatcaatatgctgggagcactcagtttctctccctgcatgaccaagttaatcaacagcagaggctgcattaatcagctttgttgcagtaacaaacacgcccagaacgtgccccagtgctggcatctcaggtggactcaggtggtgcagatcagccacttgtttgct

SEQ ID NO: 338010 - DNA, 535 bp, Homo sapiens
ttctgccactttccttctctctctcttcctctctctctctctctgctatcatttgaataaacatatcgctccagaattcatatactgaaatgtaatggattaagagatggggccttgggcaggtgactgagtcatgagggcctccctcacggatgggattagtgcccttataaaagggctggaggaaactagctaggccacttttgccctcccgccccttccactaagtgaggccagaacgtagcaaccagacaccatcttggaagcagagagcattctcatcagtcgccagacctgctggtgctgtgatcttgaacttccaacctccagaattgtaagcaatgtatttgtgctgtttataaattacccagtctaagggattttgttagcagcataaacagaccaagacactctctctcagtttcttggctctctctccgttggcctcattttctcctgcaaatgaacctcgtccatttggccagcaggagggaggatgtggctgcaggccaccaggctaacagcccctcaggtc

SEQ ID NO: 338011 - DNA, 318 bp, Homo sapiens
ccccctaggtttctcccatctccgtaagatcttgaggaccttcaacagcacttcagcaaaaaacattttcatggtttcctcaggtaattcgttcaaccaaccaaccatcccttagataaataaatatttctcaaattctcctaagaataagacactatgctgggtgctggggaatctggctgactttaagcaactacatttcttggctttatttcttgtgggccgtgggcttcaattttctcccccaaagtttttgttgtatcctctctccccattgttagctgtggaccttgggtaggttacctaaaacactgatgt

SEQ ID NO: 338012 - DNA, 469 bp, Homo sapiens
tgctgtttgccagtgaatgctgattagccaggtataccagtccaaaatataacgaaaagcaatgatctttttagcagcttgtgggggaaaagtcagaagagtacttaccctcagctcccctaatccctgggcacagtacccatcacttttcctccttgtctggaaagctctcagctctcctgttctctctcatcattccctcagtgcccctaagctccctgttggattaccttctgcatctgtctcctccagtgtaccactgaggctgccaactgggacttgtggatctcacacccctaagtagaggatctgccaaaggctgctgatcatctttacgttactcagtttttgaatcaatgacagtaccatcatttcacgaaggctgcccacagtcccaggaagcaaatgtacaccatacacaaaagaaatatgcctggtgcggtgactcatgcctgtaatcccagcactt

SEQ ID NO: 338013 - DNA, 949 bp, Homo sapiens
gaaaaaatgggatgatatatccaaatttctgaaagaaaagaaaaaatatcggtcaaaaatactatgcacagcaaaccaatccatcagaaattaggtagaaatagccagccacagtggctcatgcctataatcccagtattttaggatgctgaggcaggcgaattacttgaggtcaggagttcaagaccagcctggccaacatggtgaaaccccatctctacaaaaatacaaaaattaaccaggcatggtggcatgcgcctgtaatcccagctgctccagaggctgagacaggagaatcgcttgaacctgggaggtggaggctgcagtgagccaagatcatgccactgcactccagcatgggcaagagagtgaaactccacttaaaaaaaaaaaagaaagagaaaaattaggtagaaataaaggtgtgtctcaggcaagcaaaaattaagggaatttatcaccactacaccagcctttcaagaaatgatcaagggaatgctatatcgggaaataagaagacaataatcaccattatgtaaccacataaaagtataagactcactggtagagcagataggcaaagaaaaaagagaaaaaaaaaatcaaatcttatcactacagaaaaccaccaaaatacaatgataaaaaataagagatgaagaaaagaacaaaggatatacaaaacattctgaaaaccacaaaatgaaaggagtcttcacttaaaaataataaccttgaggtaaacagattaaattcctaccttaaaagatatatactaaatgggtttttaaaatgacccaactatatgctacctataagaaactcacttcacctctaaagacacaaatatggccaggcgcagtgactcacacctgtaatcccagcactttgggaggctgaggcgggtggatcacctgaggtcagttcgagaccagcctggccaacatag

SEQ ID NO: 338014 - DNA, 439 bp, Homo sapiens
tgaggacaggatccacgtgtcttactcacacctactgattctgtttgtggaatgtcatcatcctcttaagacacagatgaacatcttagataaatttccagatggctagtctaccccttgccactcccgcatggagatagacttgggtatatatgttgctacagacctgtacagacacttctgaatatgtttatcatctctatatgggctctttatttctgaccatgcattgaccttgactactttaagaagaggcaggaaatgataagatgaatcaagaagtaaaaaacaaattagaaaaacaaagaggagaggataaagtagaggataaattagagggtttgggggtctctgaaagatgagaaagaggctgattactgcatagattttttttttcttttctgttccaaagccagggtctctgttgtagaactgctga

SEQ ID NO: 338015 - DNA, 766 bp, Homo sapiens
atttctcggactgtctgcagcatcaagatatgggcttcagagcacgtttttagcacccgtgggaaactgttacaacagctgcaatgcagaaatatccaagccctgtgaacccgagcgtggtgtgggttgacgtgttaaacagacgtatagatccctccagagagttgcacagacttctccgcacagtgggaactgcaaaactcttactggtgcagcaaaacgcaaaacatatatactagaatattctgtagttaatcctgtagagaaaacaatggaacttaaatctactaatatttcacttacaaatatgatttcagtagatgagagatttatacacaaaccacatcatcgggaccccccaaaaaactattttgactcaagaagccataatcactgaagagaggtagcctcagcagttaccttgaaggactgatggcaagaactataccttcaaatgctaataaaggccgagaagcactgaaatgggtcatacataaattacatgttaagactgaagaattgacagcttccgccaagaggaagcagaagaacttcgatggcagcggcggcggcagcatttgtagagaattgataatgaaaatgtgaagacaacgtcaagtactccacgtctctccaagcgggcaatatatttattttaaaaatataaatatcttttaagtagaattttttaaagtaggctgatataagaatgtgacattacatcaaaacaaagagatgcatggcttctaaataaaagcgatcacct

SEQ ID NO: 338016 - DNA, 817 bp, Homo sapiens
atttctcggactgtctgcagcatcaagatatgggcttcagagcacgtttttagcacccgtgggaaactgttacaacagctgcaatgcagaaatatccaagccctgtgaacccgagcgtggtgtgggttgacgtgttaaacagacgtatagatccctccagagagttgcacagacttctccgcacagtgggaactgcaaaactcttactggtgcagcaaaacgcaaaacatatatactagaatattctgtagttaatcctgtagagaaaacaatggaacttaaatctactaatatttcacttacaaatatgatttcagtagatgagagatttatacacaaaccacatcatcgggaccccccaaaaaactattttgactcaagaagccataatcactgaagagaggtagcctcagcagttaccttgaaggactgatggcaagaactataccttcaaatgctaataaaggccgagaagcactgaaatgggtcatacataaattacatgttaagactgaagaattgacagcttccgccaagaggaagcagaagaacttcgatggcagcggcggcggcagcatttgtagagaattgataatgaaaatgtgaagacaacgtcaagtactccacgtctctccaagcgggcaatatatttattttaaaaatataaatatcttttaagtagaattttttaaagtaggctgatataagaatgtgacattacatcaaaacaaagagatgcatggcttctaaataaaagcgatcacctgaaattcgtgttgtttgaaatgactgtctgattttgaggattccagtattt

SEQ ID NO: 338017 - DNA, 164 bp, Homo sapiens
tttttattttcataccatttctgaaaacacgtcttggggacgaggataggatgatgacaagaccctgagtttctgggggaggaaacagtgcacaggaggtgaccacacagttcagagcacacccccgctggtgcagctgtgggcaggggctacaggacagagag

SEQ ID NO: 338018 - DNA, 301 bp, Homo sapiens
tcttttctcactcagctggacacatgaaaatataagtgaaggaccttgtaagccatgccaaagggcaggctcttgaggctggagaactacagggcaaggggagataaaagacaatgagaataataatgaaaggaacaggtcatgcggccagtaagcaggtgctgaaggttccagcctcgtccctctgatatcagagcatgtgctttattcagttcactctattgccagccagggaaaacttcttagggcagggtcaccgtgcagtggggctttggaggtcacaaaggtgggttggttgtag

SEQ ID NO: 338019 - DNA, 605 bp, Homo sapiens
accttaaacatttttttccactatcatttttgggattttaggaaaaacaggagttaaagatatgtcttggtcatattaaccagaaatctacttttgattttatgcttaagtgtccctcccattccaggatgtacctaggcatttttctattccttttaagaaatatgtgggcctatatggaaaaaaaagacctagataattttgaagagaaatataagatttgaataaataatgggctataccatattcttggatgaaaagactattacaaaaatgtgagtacctcctaaattagtctactagtttattataatcatggtaatttcagtggagtagagcttttggcaatttcatatggttaaggacaaaaatcagagttcagggcccaccagggaagagggatttcaataaatacttcagacttccagatgaccctcttgaaaagctatacctttgactaaaagggaatcagaaatagttcactcctcacaaagagtagtagataacattatccagaacctcaaagtatttctacaaatatgtgcagtgtctgtctttcattcaaaattatcaggcatgccacgagtgatcaaacaacagagagc

SEQ ID NO: 338020 - DNA, 167 bp, Homo sapiens
tggtcacaggttgctccagctcacccctaactccagttctccagcccaggcctgggttgggatctccacagagcattcctctggctcctctgttgggttaatccccacacctccttctgggaagagcctaaacatcctttcccccaggaagcctcccctttccccta

SEQ ID NO: 338021 - DNA, 151 bp, Homo sapiens
atctccctatcccctgcccataacaacagttttattctctatctctgtatatttggctttttattttagatttcacaaataagcgagataacacaatatttttctttctgcgtctgacttatttcccttagtataacatcctccaggttca

SEQ ID NO: 338022 - DNA, 880 bp, Homo sapiens
gggctgggcctcgctccaccctgccagggaaaccagctgaccaggtttaagggaggaagcgtggcactgctacaaggggggcagtagcaaagagatacaaggctgaggagatgctcctcgaggttgagacgagcatctgttgagcaccaggtactatgctaggctcagggaggtgcaaaggggccagagttgctgcttccaggagctcagagccgggatgatccttacagccaccttagggagtaatggccagaggccatgcagagcatggggagccattctgcttgggcaggtcagggaaaggcacagagaaaagatgacagctgagtttgactgagaaagataaaaatatttctcagttgcagggagagggccaggtattccagagtatcctttcatttcctgcttttgctgcatgcaaataggaagaagccaagaaaagatagtgagggcaaccaaagagttgagagcgatgcaattaccaccttggctactgatccaactcacttttctgctaagaaaagataactatgaggaactgacttcacgctgatacaaaggctaccaggtcctgactagatgctgatagggctgagatcaacagggtcagcttctactcagcctgagatatcatcccagaatagatgaaaatgtagttgagcttttaagaatgaaagagattctgtatgaatgggagggttaaagggagaggagagacagtgggtaaatcaaggagcctgggagactgttcccttcatcaagataaaggtgcttaggatagagaggtagagtgagagtgagagctttgaagccacagttaagaggaatgactcagaagggggagccatggttggagatgacactggcagagaagctagag

SEQ ID NO: 338023 - DNA, 323 bp, Homo sapiens
agagcaacaggaatgataaatagttggataaatatatcacactatttttttgcctcaagtttttttaaaaatatgaatcaccattgagagcaaaagttaaaagactgatgggttttcgaggtaggcagatctaatacatttaataattgcaacatatggaggtggtaaaatgtaaccgatatcattgcaagttttctatgttttcctcgaagtactacaatttcaactctcagtgtactgagaaaagttaagtgtatatattgtcatgcctacagcaacctgtaaaagaattacacaaagagatacagtcaaatgttggtcaa

SEQ ID NO: 338024 - DNA, 986 bp, Homo sapiens
  misc_feature (956)..(956): n is a, c, g, or t
catgtggctatttggtggaagagtgtgccagagacagagaacggcaagtgcaaaggccttgaggtgggtgtgtgcctgcatattgggagactggcagggaggctggtgttgttggagtagggcacgtgtgggtgagggtagtgggttatatgacctgagaacaaagccgggtgtcagacactttggctgtcatgaagactggcttttactttgagggaactgagaaaccactggaggattttgagcaaaggagtgatgtgatctgattaatgtttcatagaatcacactggctgctatattgagactagatgaaagagaatgggggcaagagcaaaagcaaaaactgggagactagttaggaagctattgcagttacccagatgagagatcatggtggcctgtctgaggtggtagcagccaaagcggtgagaagcattcagattctgggtgtattttgaaggtggagatgagaagatttgctgacagatttgaagtgaaagaaagaggaatctggataactccaaggtttattaaaaggatacctactttagagcctaccatgtgctcaggtctgtggggcattcagaaggagcattcacattgcccttcccttcaaggaggctaaactctagctgctggaagaagatttaacatgtggcaatatgctatgggaaaatgtgttgcttagtactccaagtaggccaggcacagtggcacatacctgtaatcctagtactttgggaggccgagggaggaggatcgcttgagcccaggagttcaagatcagcctggacaacatagagagaccctgtctctatgaagaatttaaaaagttagccagacgtggtggtgcacaattatggtctcagctactcaggggactgatttgtgaggattgcctgagcccaggaggtcgaggctgcagggagctgtgatcgtgccactacactccagncctgggtgacagagcaagagcaagaccctc

SEQ ID NO: 338025 - DNA, 296 bp, Homo sapiens
accccatctctactaaaaatataaaaaattagccaggcgtggtgatgcatgcctgtagtcccagctactcaagaggctgagataggaggacctcttgagcctgagaagtcgaggctgcagtgagctgtgattacaccactgcactccagcctggatgacagagtgagaccctgtctcaaaaaaacaaaagtgatcagagaagctgcaccgaaaaggtggcagtcgagtcaagacttgaagaaagtggccatgtggctatttggtggaagagtgtgccagagacagagaacggcaag

SEQ ID NO: 338026 - DNA, 947 bp, Homo sapiens
cattggtacccagaaccataaaccatgttacgtcaccaatacccgactcccatcaaattacttgagggcaagaattgagttttttcttcattaaatgttaaacatagcccaaaatgagacccaattaacatgggacaaggaaaaataccaattgagcaaagatcattttcattaatacatttaaaattccttaaataagacatttaataacaaaattcaacaccttatagaaatttgtacatactctttctgtacaaccagacctgtactagtaagggtctcccaatacctgcagctcttattcaattatatgaaatatttattcaaatattaaatgacaaaccacatatcttaataaaccagtaaccataaagtgctaagaatttgttttcaggctcactgttcatatggggagcaggcgtgtagaagaatggaatgtgtgttcaaggacaatgtacttggccctcgggccttgaccaatgaggctgtgcatgaaaaagagagatgagggtttcacaaaagttgccagtgacgccagggaaatgttacacagctgattttccaagataatgggaactgcagagccagagcagctttcttcaacatgcggaataaccacctgttccttaccttcgcagcatctgagaattttcagcaggcatctccaataagggcaaatgttactaggttgggttaaaactgagctggctccaagataggattaatgcgtgtctaaccaaagattccttctaactttaaatacatccacagggctataccacacccacacactaaaaccctgaagaaatgaaaacccattattatcgaaagaaaatactggccgggcacagtggctcatgcccggctaattttgtatttttagtagagatgggcttcaccatgttggccaggctggtcttgaactcctgacctcaagtgatccaccc

SEQ ID NO: 338027 - DNA, 440 bp, Homo sapiens
acaaaccatatcatcactgtgtatatgtgtgtgtgtgtgagagagagagagaatgaggatattgaagtatagagatggagatgagagattcaatttaagagatacttgtagaaataagaggagatggtcactgaatgtctagtgtgtgaggaagtgaagaattaatacaagttactgatggtgatgtcctggacctagagaagaagtcaggaaaagagttgttggaggaaggagctaatgcatattgtttgggacatatggtaggtacaattgaaccgtagttatatactgtcttgtgttgaaactttgagataattcaggtgctattctttgcttttcttggatcgtacagagattcctttcatgagaaccttcatgagagccctctggacaggcacaggccagagtagagacttgacagttaacattttagacagtag

SEQ ID NO: 338028 - DNA, 357 bp, Homo sapiens
ctgttcacacaacaaatcctacaataaaaaatacatctaaaggaaatactcaattatgtactcaataaatgacatcagcctgtgtcttctgattcacagcagccttactgctttgcttgcttgttttgagagaagggagatcttacaaaacactaaaaactctaccatgttcacccagaggacaagctaatcatgagaattgtaatatgtatttctggtctaaataaagtcttcacatcacacatcccctgttagaacttccaggtatgtgtaggaaaccaaatagtgtgcttacattaagaagtgttttcatgatggtgcatttcctacctcattcctaggtggtttaatttgttt

SEQ ID NO: 338029 - DNA, 449 bp, Homo sapiens
gcaaagactaaaggacactgaaattccactgccactcgtttcctagttccaggtagaactaggaagtgccagtcaccagtttctagtttggagggaacaattcactcctgggagtagagggagaggaaaggaggagtgactcaccagtgtggggaaaagcaagagagatcagattgttactgtgtctgtgtagaaagaagtagacataggagactccattttgttctgtactaagaaaaattcttctgccttgagatgctgttaatctatggccttacccccaaccccttgctctctgaaacatgtgctgtgtcaaactcagggttaaatggattaagggttgtgcaagatgtgctttgttaaacaaatgcttgaaggcagcatgctccttaagagtcatcaccactccctaatctcaagtacccagggacacaaacactgcggaaggc

SEQ ID NO: 338030 - DNA, 750 bp, Homo sapiens
ggcttgcctctgtctgcaccacgctctgctctgcggcaaatgagagacagctgatgtgaacagggaggcaaagaaaggcaacaccaaaaactgagggccactggaaatatgtagaaaatgcaccacttctttcatttcctgcccttccccagccccaagaaacacagtaaaatgaggcgaggtccatctcactaagatcaaggccccagtaacgcacaccctcatccaaaccaagtccctgtctactctgacactgatggatggcaaacttttaacacattttctttgggctgagtagcaaaataatgagcaagcaacaaaatgaaggggtagctgaataaattacattctgacattttctatctcatccaatccttgtctttcaaacaaatgacaactgtatctaagttgatagataacctccttggtacagaaacaaactaatggaagtcatcagtgttgaaagtctaaccagggccgtgacgatggaaggaagaagacgaattccacatgtgataaactcaagcattagaatgagtctatcacatgtggcatcgataaacaccggtgtttatcgatgccacagcttagaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccaccgtaa

SEQ ID NO: 338031 - DNA, 524 bp, Homo sapiens
tacgagaggtcttccagtccattaatcttgtgttaagtttcttggctggaagggtggtttatagaagtggtgccaaacagctgtaaatgcaaggctgagaactatttgtcctcttcctttatttttaagacttcagaaaacaactttcactaaattggtaaataaagttttaggtattattttctgattaatgaaatcaccataaactactacttctagacttccgaatgtcatgattttatttctggtcttattatatttgtgtttctgagtcttaatgagctagaaatgcttataagacaaaagcaatgtgtgttttttcctgcatcagattcttttacaccttatcttgaagtttgcataactgagtcactttctatttttttttaatcactttgataagagaaaaatttatgttagttgcagtccaggaaaaagaaggcacaaacactgctgatcaaatattactaaagcttttatggactcttgaacctcattttccctcccatatgtacacaagacac

SEQ ID NO: 338032 - DNA, 284 bp, Homo sapiens
ggactctgctcagcttgagtcagcagcctatttccagtccagtcactggccagagggaggatgggggacgttgtacacagctctgccatagctgaggggaccagttaatgggttcattgtgagccatcaagatattccaaaaagtgtctagaagacacttctccatgtgactctggactgacctagttctccccccgaccaccatttcttggttgtagttctcaagaataatttttaaatgttctgggaatgcagtatcattagagaggaactgcctgaaacag

SEQ ID NO: 338033 - DNA, 273 bp, Homo sapiens
atgtaatcttgcatcttacaagtacgtggcagctagggaggcagattagtaaaatgactcctttcaaacctttattctctcagacctgggacagcccatggcctgatgagatctcacttcacgagcacaatagctccttaaaaacagatcctcactgtggcccacgagccttgaggattccctgctgcccatttcagcctcttcctcccctttctgcacccaggatctttgcaatgcctgctccctgaaatcaccttctccccactcctgcct

SEQ ID NO: 338034 - DNA, 624 bp, Homo sapiens
ctcccaacttctgacaccaatcaccagctggggttgtcttacccatgtttctaactgactggctataaactaaggttctcactaccccatccttgtgtttgattaatttgctagagtggctcacagaactcagggaaatgcttatatttaccagatgcataaggcaagggatatggaaaggggcacggagcttctgtgccctctctgggtatgccatccttcaggaacctccgcatgtttggctatctagaagctctctgaacccagtccatttgggtttttatgggtgcctcattacacaggcatgatcaacttaagtttcatcctctctctctgccttcctggaattggggatggaggactgaacgtccaaccctctaattatgccttggtctttcctgtgaccagctcccatcctaaaactatatggactgcaagccttattagcatataaaagacactcctattaccctggagattccaagcgttttaagagctttttgccaggaaatgggatgaagaccaaatacatatgtatttcacaatatcacaggtaccccttaggaagttataattgaccaagagatgatggtggtttgggtaaagtagtgacagtgaagatgg

SEQ ID NO: 338035 - DNA, 508 bp, Homo sapiens
gggggtggggaggattttggaatatttgcattattcttaccagttcagcatcctaatccaaaaatctgaaaaccaaaatgctccaatgagcatttcctttgaacatcatgtcggcactcaaaaagtttgagatcttgaagcattttgaattttggatttttggattagggatactcaacctgcatttcaaaaatgtttattgggaactggtcatgggatagacattttcctagtcacgaagtacttaaggatggaagaaaagtggtccttgcccttgagcatctgacagccccaagggagatgtaggattgtaagtaaaccactagatcaatgtgttaagtgctaaaagagaaatatgctaaaaggtgctgggggatcctaacatttatctctgctgaaggcgaagatgttcaataagctagtgggtctagttggttgaataaagccaagagggaagaggaagagtacttcaggtccagggaacagcacaaaggcatgaaggaataag

SEQ ID NO: 338036 - DNA, 585 bp, Homo sapiens
tatcccctggtcccctggactcctttcctacactgaagaaaatgtaagctgaaagtttctattctaaaaaaataaaagatgcttaggtttaatagtatcatccaagagtcaatgtcctgtaagtttcgaaaaccctgaagtaggaattaagtaccaatttcctccagaaattccatgcgcttctccctgctcccttccccatttcaaccaccaaccacaactattccttctccatagtatattcatttgtttgtctgagtttgatgcctgctttcttctttcctaattacttgactttcccttgagcatcagtaacatcaggcctattcaatgtaaagcaaggtaatccccaaactgtttaagcaaatccaaaagatcccaaactctgtgaatctaccccctcaccaccttcttattatgcataatcctttattcacagtgctctcccttggttcattaaaatacctgaacagcttagaaagtcctaaagatgtaaagcagtaatcaaacacccaacatagcagactacctctcataaactcctgaagattctatctgtgatatccaattgacatttcttggaaa

SEQ ID NO: 338037 - DNA, 161 bp, Homo sapiens
ataattataattgttcaatcatttaaaatgttggaaaacacttccattcttctttgtaccactttcaccacacatcaaaactgctcttatatatgtcaccagtgagctccaagttgctaaattcagctttcaattcttttttttttttttttttttttttt

SEQ ID NO: 338038 - DNA, 303 bp, Homo sapiens
tgatcagaatgccatgtcatctagtcgggcacaacaaatgcatgccttttcctggattcggaataccctagaggaacatccggagacttcactgcccaaacaggaagtctatgatgagtacaattcttactacctcaccaaaagaaacataatggagctagaagaaagtctagataaaaatatctgaaatgatcaagagaacaaagttaaactgaaggactctagatttattttctctttacaaaggttaaaactgagagtgcatgtgatccaacttgttcattcattcagtctacaacaatc

SEQ ID NO: 338039 - DNA, 184 bp, Homo sapiens
cttatgagaaatagaaataggaacagaaaaaaatactgcacaaaactgaaaacctttctaacttagtgagcttctcacaataaaacacgcagtgaatagcttgtattgtacaataaaccataacatataaaaatcgcctgccaactgggcatgatagctcacatctatagtcccagttacttca

SEQ ID NO: 338040 - DNA, 346 bp, Homo sapiens
agtgactatgcttcaggcactttcctttgcttcttcttaatgtttgttcgggtgggtacctctgtgcagatgcctataaatgagttcttagggtataggagtaaccacccagtcatcaggccatacttttgtttttaggcaggcttaactcagaaagtagcagcatatgtaattgctaagccaaaacctacctgaaatacttcagaggctaagcccctttcctagccaaatacctaactactagagttgctctctgtcagtaagttgattccttgcctgcacattatcagacctgtttctggagccatctttctccctaaaatgacagctgctacagtttccccca

SEQ ID NO: 338041 - DNA, 231 bp, Homo sapiens
tatgcacgaagtggagaaggactggagggaaacaagataggattgttttgaaagcggcacagtgccactcaggcgtaatctgttttttgaacagtggagggaaacactacacgagttcaaggaaacaagtgctgtttcccatacagtaggtctgatttcccaatcttgccatatttttttaggcatctggttctatttttttttctaatcttgtgcgctttagaggttagt

SEQ ID NO: 338042 - DNA, 361 bp, Homo sapiens
cttcaactttgttaaatcattgtttgttcaatttaaatgtagcacttcatgcccacatcatcatccagcaaccccagatccaaggctggaactgaggcccctgactgcaaacatttacacacatcctcaacctaatttcgtcaaagtagtttgtataacccggttttattaaagggtgattcgtgtaccctgagaacacttctcagtttgtctttcagcctttgttttcacccctaaactgtgctctgtctggtgcagaactccatgctgattctcaagtaccaagcagacacgctttgtgtcactatcgtcatgtcttgctctgtgtcgtgcgattgggatcctaaagagtcgcctcagc

SEQ ID NO: 338043 - DNA, 4768 bp, Homo sapiens
gcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaagctgtattttgcagaatatggttctattttagtagagcagagatgagacatatccccaccggccacccagccagaggtctcctacctgggggccctaaagggatgcagaggtctggcccaccctccgtgcataggcacctctgtccaccaccagcgtttcagcaatccaaccagtaagcatatgctgtataggaaaaataaaagtgtgtgggaattggatttcttttgttgtaacacaattccaggtttttggctatttaaagtttgacattaggctgacatcgaggaagtaagtgggttttcctgagttcccaagatatgattaagg

SEQ ID NO: 338044 - DNA, 3978 bp, Homo sapiens
  misc_feature (3914)..(3914): n is a, c, g, or t
  misc_feature (3918)..(3918): n is a, c, g, or t
  misc_feature (3926)..(3926): n is a, c, g, or t
  misc_feature (3928)..(3929): n is a, c, g, or t
  misc_feature (3931)..(3931): n is a, c, g, or t
  misc_feature (3939)..(3939): n is a, c, g, or t
ttcataattatcttaaggaatgacttgattcttacttgtgcttgttctttttaaaagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338045 - DNA, 3979 bp, Homo sapiens
  misc_feature (3915)..(3915): n is a, c, g, or t
  misc_feature (3919)..(3919): n is a, c, g, or t
  misc_feature (3927)..(3927): n is a, c, g, or t
  misc_feature (3929)..(3930): n is a, c, g, or t
  misc_feature (3932)..(3932): n is a, c, g, or t
  misc_feature (3940)..(3940): n is a, c, g, or t
cggctaagtcaggacgcagtgttatcggccgagggaggaacaggcagaagatagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338046 - DNA, 3444 bp, Homo sapiens
  misc_feature (3380)..(3380): n is a, c, g, or t
  misc_feature (3384)..(3384): n is a, c, g, or t
  misc_feature (3392)..(3392): n is a, c, g, or t
  misc_feature (3394)..(3395): n is a, c, g, or t
  misc_feature (3397)..(3397): n is a, c, g, or t
  misc_feature (3405)..(3405): n is a, c, g, or t
gtgtccatcccccttcgtgcgtccatcccccttcgtgtgtccatcccccttcgtgtgtccatcccccttcgtgtgtccatccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338047 - DNA, 3465 bp, Homo sapiens
tcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcatcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaggactatttgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatcccca

SEQ ID NO: 338048 - DNA, 3759 bp, Homo sapiens
tcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcatcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttctttttttttttttttttccggtgtaccagggatttttaaataacggactatttgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccaaaaaaaaaaaaaaaaaaaaaaaaaaaaaaacaaaaaaaaaaaaaaaagaaaaaaacaaaacaaaaaaagaaaaagaagagaatgagcccaatcaagaagaaaaagaggaaggggagaggagagacacgaaagtagagaagagagaaaggggagaggcgcaaagaaggaggagaaagagagaagaagaggataggagaaggagagaagagaagacagagggatgtaaaaaaaaaac

SEQ ID NO: 338049 - DNA, 1619 bp, Homo sapiens
gccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacatcacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttctttttttttttttttttccggtgtaccagggatttttaaataacggactatttgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatcccca

SEQ ID NO: 338050 - DNA, 1183 bp, Homo sapiens
  misc_feature (25)..(25): n is a, c, g, or t
  misc_feature (1119)..(1119): n is a, c, g, or t
  misc_feature (1123)..(1123): n is a, c, g, or t
  misc_feature (1131)..(1131): n is a, c, g, or t
  misc_feature (1133)..(1134): n is a, c, g, or t
  misc_feature (1136)..(1136): n is a, c, g, or t
  misc_feature (1144)..(1144): n is a, c, g, or t
gctgtctctagaggatccactctcnctactgtatcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338051 - DNA, 553 bp, Homo sapiens
tcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaaggtaaaataaagacaaacccatattatttacttcagtatatagctcaatgtctagaaccagcacttaggctccaactagtgactctaaaaccagcagtct

SEQ ID NO: 338052 - DNA, 451 bp, Homo sapiens
cggatggttctaatttgctcttttaatatgtctcagattttcacacgaaggccagatccagaagtaaatttttatctgaattctggtaaattgtgcttataagcccatgaaatgatcagcaatagagggctttcattagaatatgggcactcctgtggtttttttaagaatacaacaagacatcaggaagcaaaaacgtttaaaattagtaaagcaaaccagtcctacaaaaaaagcatgtgtgtgtgtgtgtgtgtgtgtgtgtgtgtatgtgtgtgtgtgtgtaagatgatcaaccttcctacaaaatattttgacaactttttaacaatgttggttgtgtgtttgatcattatttgttagagtcacatgatcgtggcctgatacacttttctgaatatgaaatcatctatagtaactgtcatcacgactttcctcctttaataaacag

SEQ ID NO: 338053 - DNA, 255 bp, Homo sapiens
tcaagtaccaagcagacacgctttgtgtcactatcgtcatgtcttgctccttgtgtttatatggtgtgtgtctgtatcagtctgcttctgttcactttctcgtttatagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaa

SEQ ID NO: 338054 - DNA, 4389 bp, Homo sapiens
  misc_feature (4325)..(4325): n is a, c, g, or t
  misc_feature (4329)..(4329): n is a, c, g, or t
  misc_feature (4337)..(4337): n is a, c, g, or t
  misc_feature (4339)..(4340): n is a, c, g, or t
  misc_feature (4342)..(4342): n is a, c, g, or t
  misc_feature (4350)..(4350): n is a, c, g, or t
gcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338055 - DNA, 4135 bp, Homo sapiens
  misc_feature (4071)..(4071): n is a, c, g, or t
  misc_feature (4075)..(4075): n is a, c, g, or t
  misc_feature (4083)..(4083): n is a, c, g, or t
  misc_feature (4085)..(4086): n is a, c, g, or t
  misc_feature (4088)..(4088): n is a, c, g, or t
  misc_feature (4096)..(4096): n is a, c, g, or t
tcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338056 - DNA, 4118 bp, Homo sapiens
  misc_feature (4054)..(4054): n is a, c, g, or t
  misc_feature (4058)..(4058): n is a, c, g, or t
  misc_feature (4066)..(4066): n is a, c, g, or t
  misc_feature (4068)..(4069): n is a, c, g, or t
  misc_feature (4071)..(4071): n is a, c, g, or t
  misc_feature (4079)..(4079): n is a, c, g, or t
cggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtacccacnacancaaaaaananngnggggcgcnaaaaaattaaaacggggcgggcccgagaaggccggtcaa

SEQ ID NO: 338057 - DNA, 3524 bp, Homo sapiens
tcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcatcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttctttttttttttttttttccggtgtaccagggatttttaaataacggactatttgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatcccca

SEQ ID NO: 338058 - DNA, 3880 bp, Homo sapiens
tcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcatcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttctttttttttttttttttccggtgtaccagggatttttaaataacggactatttgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccagttttagtttgttccagtttctcttatatttggatagtgctcagcctttttaaatgaaaaaagaaaaaagagtaagacaacttccctaattgcctgttatttcagcttcacctaagtttttaacacctctttgtatgtaaggtcttgagacatgtaaggcctggtactttttatttaaaatgtctgtctaaagaattactgctcttaaaagaaacttccagtattttttttaacttgctatctttttatgtctgaggtatttgatattgatgtttttattgccattattatatgtaaacataaaagatagtccatttagagtttataatatagaaaataaacagacttcctcatta

SEQ ID NO: 338059 - DNA, 8120 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagtaatcaacacagaagacttctgtgaccaaatatgtggagatttctcccacccagcaagcagtcagttctgcagcagataccagctatgtgtcctccaattcaattctgactatctacctggagatagtgtcagatctcactggcttaggactcagtcccacaagaccgctccccacttctgatgccaatcgcaagccccaggctgttttacctgggcttctgaccaaccagctgtacatctaaatcagggatcccatgaccccctcctggggtttgcttaatttgctagactgtctcacagaactcagagaaacaatttaccagtttactataaatgatattacaaaggatacaaatgaagacatgcacacgttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttc

SEQ ID NO: 338060 - DNA, 7861 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttctccctggcgccattctcctccttctttccctagagctaacgtactaattctgaagttggtgtgactccttcctgtttaagattttatactttaccatgtgtttttatccagaa

SEQ ID NO: 338061 - DNA, 3549 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcaccctgtggtatgttattattattaagcctccctttgaaaatgggtgtgccccaaaagtaagctttgcatctcttacaagaggggagctacaggggcagccgtggcctaggcccaaactatgctctgagaaaataaatatctgtcccacc

SEQ ID NO: 338062 - DNA, 4526 bp, Homo sapiens
ataattactggcagttgcttgggtgcaaagtcttaggtgaattgatgccatcacaaggtgctttatttaattctgtaaaaggaatccagctagccagtgtttaaacattttattcagtatgctttcaaaacggaatataatttttttctttcctttttcaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttc

SEQ ID NO: 338063 - DNA, 163 bp, Homo sapiens
tctggtagaagtctgtttacctatttcatttttattgttttttcagacaacaagtgagaatcaggcattgtattctattccacttgtgcaactgtttgcctgtgtcagctgtgatttggcctgtgacctcagtgctttctttgattccacaactctggatacc

SEQ ID NO: 338064 - DNA, 479 bp, Homo sapiens
gagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaagtaagaattcatccaattgaatcaatgttacagtggtctaaaaaaatagaatatatgcttagtttttacttttaattatttaaagtaaaatttttaaaagaaggagatctgactgcttcacttatagggaccctaagttgcctcatcttttaggttattgttctctatacacaatttatatttcaatagtcctggctatagtagttattttaaagaaaactcattaaaacatttactcatt

SEQ ID NO: 338065 - DNA, 391 bp, Homo sapiens
agaagcctttaaagtatgtctttaatggagaaaaattacatctggttccaaaaacttgggaggttattttaaaaaccaacattcataagttgggagacatgaacatagccaagcagattctcttctttcagaattgtaattcaactttaaaatttgtgaaattgaataaaaataaaattggtggttatcagtgtgtagtgacttatttttcttcttgttaacagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgctt

SEQ ID NO: 338066 - DNA, 256 bp, Homo sapiens
caaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccct

SEQ ID NO: 338067 - DNA, 7748 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttc

SEQ ID NO: 338068 - DNA, 7220 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttc

SEQ ID NO: 338069 - DNA, 5027 bp, Homo sapiens
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacaggtaaataaatatgtgacaactttcgatagttctgtcctaatatgcttctgatactgttctaaataccttcctttcagtttaataaaaggaaaatccttatgttttaatctcatcttttaaaatttattttattttgtttatttgagacagggtctcactctgttgcctgtgctggaatgcagtggcacaatctcggctcactgcaacctctgcctcctaggctcaaccgatcttctcactaagtagctgggactacaggtgcaagccaccatgcctggctaatttttatatttttgtagagatggggtttcaccgtgttgcccagactggtctcaaactcctgagctcaagcgatccacccaccttggcctcccaaaatgctgggattacaggcatgagcc

SEQ ID NO: 338070 - DNA, 3086 bp, Homo sapiens
ttctttgctctccaccagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacatttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttc

SEQ ID NO: 338071 - DNA, 670 bp, Homo sapiens
gaagttcctacatgtcagaattctctggggatttgaacagaggaattgaggactgtcttggaatcccccatgaagaactactaaagatatgcaaatacatacaagagacacaggaaactgaaagaatgacactacgattcagccatattagccttctggccattcctcacattctgggcagactcctgcctttgcatctgagcatttttcctttgcagggaatgcttgagtcccacatttccccgtggctgactctgttaccttcttcaagtctctgctcaaataggtttaaccaaccaattggcaacaccacctctcaattcctggcacttcctaaccccttccctgttctatttcattcaccatcttatgtactacttaggtatttgctttttgtctttctcccttccctagaatgtaagctctatgatgttggagattctcaaggatctttttcactgcgtcctcggtacctagaggatcatagaagaggcactctgtgaacatttgttgaatgaatgtcgaacccttgtaccaggatgatctgataagcctcagcacatctcagagaacatgctggttgctatcatcttttccattgcacagagagctacactgtcaagcagtttaaccagttgcctagataccactctgaccaggcatgaacagg

SEQ ID NO: 338072 - DNA, 927 bp, Homo sapiens
catgacttattttgtcctagagattccaatctgctggacactcagaaactttcacaacttctatttttcacattttttcatattttaggcttcagtgcagaaggattaaaagtaatggctaagttttctaatgctgttatttattttttcttgaggctttatggtcactaaaaaagtaacaatatatagtacgtaaaaaaacttaaagatactgtggcttataaaagcgtatcttttttctgagaacaaaattagccaattaaataataaaaccatcaagagatgtcaccagtcaatgatgatggggcaaaaattgttctgcattccgaggagggagaaatcgatgcaagcagaagtgattaaacattcacatcttggagctaaatgacctcctaggatggatgggttttatagaggtggagaggtggggggagggtgctggatgaaataactggaaaatctcctttttcttactatttttcttcagtccctttataggcacaactgcttaaagaaaccagatggccccaggatggtgccagagcttcctgaccccttatcagataccagaggaagataagactgcagagcggaacaggataggcaacccctggttggcttcagatcattatcatgtcgttataatgctaaaattccttctcctaaaagaaagtctccaccattttgtgtacatgtgatgtatgaagacgtatgtttatgaattgtgtgtgcacatttagagtctcactttgcacatgctaacattcctctcctgtcccacacctagtcctaaaaactccatgccttctagtgtttggggagaaggggcatttagagttaagagccccttccctggccagcgactaaaacctggttaccgtttacagttgaatgtcctctgcgtaaatcgatacaaagtggggaaag

SEQ ID NO: 338073 - DNA, 107 bp, Homo sapiens
tatgattccacttttcgagtcagtgccccagatggtttgctcattcattcattcaccccaaaaaatgtttattgttcacctactatgtggcaagcatcacactaggt

SEQ ID NO: 338074 - DNA, 604 bp, Homo sapiens
atcagttctatcaccaagtcttctaagtactctctccaaaatttacccccaatatattgaattcctctccatttctacagctcccacccaaatcaagccaccatcacctttctcctgggctactatagtagccccttgactggtcaactgcatttatgcttacctttctaaagattactctccacagcaacagcaaatggtgtgtaaaaaacgtaaactggttactattactattcccccagtctaaatgaccaaccaaataaaaatctttcagtaccttctcactgaactgagaatgaaataacaacctgcagcttacagcgctgtatctggctctcatttctccaatcttatttcatttctctttaccccttatcagctacttcacttcggccataccagcctaatctctttcttcgttaagactcagttcccatctcatggcattacattcttgacattccaccccacctcctgaacaatactttcttcttctggatgtcagccaggtctcaagagcagcctcccaatattgccactcacaacaattcatcatttctgcctatttgtttccttcacagaactgattacaatctgaaattag

SEQ ID NO: 338075 - DNA, 312 bp, Homo sapiens
atcagttctatcaccaagtcttctaagtactctctccaaaatttacccccaatatattgaattcctctccatttctacagctcccacccaaatcaagccaccatcacctttctcctgggctactatagtagccccttgactggtcaactgcatttatgcttacctttctaaagattactctccacagcaacagcaaatggtgtgtaaaaaacgtaaactggttactattactattcccccagtctgccatgtaagtcttgtcacttccacgttgcacaatgttttacgtaagtctggcttcgtattctccac

SEQ ID NO: 338076 - DNA, 602 bp, Homo sapiens
agaaattcttttctactttaattcccatctataggaattctagtctgctctacttactatttccttcccatcccaagaacccaatcacatcctaggctgccgcacagtttctcacaatatgtatcagtttaacatcttcaactacactccctggcttcagcaatgtcactcccaaaagagagggccattagcccgtgatcatttgacatcaagtaaacagcatcacaatctaaccagatgcttaagccaaaaacttcagaatcatcctcccttcttaactcccacatcagttctatcaccaagtcttctaagtactctctccaaaatttacccccaatatattgaattcctctccatttctacagctcccacccaaatcaagccaccatcacctttctcctgggctactatagtagccccttgactggtcaactgcatttatgcttacctttctaaagattactctccacagcaacagcaaatggtgtgtaaaaaacgtaaactggttactattactattcccccagtctaaatgaccaaccaaataaaaatctttcagtaccttctcactgaactgagaatgaaataacaacctgcagctt

SEQ ID NO: 338077 - DNA, 239 bp, Homo sapiens
tgctgggattataggcgtgagcccccgaacccggccactcccagctaagtttaaattttttgtttgtttgttcgtttgtttttattttttgagacagagtctcccgcccaggctggagcgcagatcactgcatccttgacctcccaggcttaagccatcctccccactcagcctcccaagtagctgggattacaggtgtgtgccactatgcttggctaagttgtgtattttttgtagag

SEQ ID NO: 338078 - DNA, 2642 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcg

SEQ ID NO: 338079 - DNA, 454 bp, Homo sapiens
accgttgatagttgtgaggtctaagggtacatctagtagtatggagagcttccatacctgcaggcgcgtgcgcaaggcagtcgtgtttcagtatatgctgatctggtagatgagagcctagcactgtaggatgacgagtcggccttagtcacggtgttgactgatgagtgcctgtgctattgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcg

SEQ ID NO: 338080 - DNA, 461 bp, Homo sapiens
  misc_feature (420)..(421): n is a, c, g, or t
  misc_feature (427)..(427): n is a, c, g, or t
  misc_feature (446)..(446): n is a, c, g, or t
ggcttcaggccacgcttcaggacagcctgcagcagcctggcacgcacgtcctccgccgagtacaatgtcaacaacctggtgagccctgtgctgttccaggaggccctgtggcacgtgcctgagcacgcggtggtgctggagatcgcgcccccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggaatnnacatgncatcccgtcccaaagcaanaggatcgtctagatg

SEQ ID NO: 338081 - DNA, 3167 bp, Homo sapiens
  misc_feature (2759)..(2759): n is a, c, g, or t
  misc_feature (2766)..(2766): n is a, c, g, or t
  misc_feature (2802)..(2802): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338082 - DNA, 3338 bp, Homo sapiens
  misc_feature (2930)..(2930): n is a, c, g, or t
  misc_feature (2937)..(2937): n is a, c, g, or t
  misc_feature (2973)..(2973): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggtgagcgtggcgcgggggcagggtggagtgggtgctggtgggcaggggtagggggctgccagagggaggggcgctggaggcgggggtggtggctgcgccacgcgggaaccccaggggctgggcctggcagggtgggacctgcagccccgacgccctcaccccgccccgcaggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338083 - DNA, 2122 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcaggtccgcatccaggagatgctgcttcaggcgccgccactgggccccgggacccccacggcgctgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcg

SEQ ID NO: 338084 - DNA, 2089 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgagtcccactcggggatggagtgggccggcggccaaaccagtcactcggggaggaatgcggaggagcgctcattccattctatttaattgcagtgtacaaaattgtgtttgtatatagaataaactgtctgttgacagcg

SEQ ID NO: 338085 - DNA, 3441 bp, Homo sapiens
  misc_feature (3033)..(3033): n is a, c, g, or t
  misc_feature (3040)..(3040): n is a, c, g, or t
  misc_feature (3076)..(3076): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctgggtgagtctgagctgctgggcttggggagctccatggcggggcctcccctcctccctcgggtctcctcctgctggtgcgggacggggggctgtgcaggaagcactggggtctgccccgccccaggcacgcttcccagggctggggtcctggatgggtttcctaagaatgggcagggccaggaagcaggccaggcctcagcaatggagccagctggggcagggcccagggggtggcctgggcggggctcccggctccctgattcacccacccgcagaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338086 - DNA, 1821 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcg

SEQ ID NO: 338087 - DNA, 3132 bp, Homo sapiens
  misc_feature (2724)..(2724): n is a, c, g, or t
  misc_feature (2731)..(2731): n is a, c, g, or t
  misc_feature (2767)..(2767): n is a, c, g, or t
cccaacgtcgtggggtaacatctgttatcaaactccgttggtgttgtggaaagcatgtagactgacccagaggccagacccaggggttcatgcacccctgagccagcagggcatcttggaaaaggaactcttggttcgatacctggaacagaggaggggaaagtccagggctatagggtgtaatgaagtcacccctttctgtcccactacatctgggagtgactttccgagcatcccgtatacaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338088 - DNA, 1440 bp, Homo sapiens
  misc_feature (1432)..(1432): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgtcttctatctctacgacacgacattccgcacancacacgaa

SEQ ID NO: 338089 - DNA, 1456 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggtgaggcctgggcggcaagcagggggcaggccagccgtgcctttccaggcaggagag

SEQ ID NO: 338090 - DNA, 3689 bp, Homo sapiens
  misc_feature (3281)..(3281): n is a, c, g, or t
  misc_feature (3288)..(3288): n is a, c, g, or t
  misc_feature (3324)..(3324): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctgggtgagtctgagctgctgggcttggggagctccatggcggggcctcccctcctccctcgggtctcctcctgctggtgcgggacggggggctgtgcaggaagcactggggtctgccccgccccaggcacgcttcccagggctggggtcctggatgggtttcctaagaatgggcagggccaggaagcaggccaggcctcagcaatggagccagctggggcagggcccagggggtggcctgggcggggctcccggctccctgattcacccacccgcagaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcggtgagtgtcccgccggcgcagggcggggcgggcgtcctccaggccctcaccgggcgcccgccgccctgtgcccgcagtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggtgagcgtggcgcgggggcagggtggagtgggtgctggtgggcaggggtagggggctgccagagggaggggcgctggaggcgggggtggtggctgcgccacgcgggaaccccaggggctgggcctggcagggtgggacctgcagccccgacgccctcaccccgccccgcaggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338091 - DNA, 2577 bp, Homo sapiens
  misc_feature (2169)..(2169): n is a, c, g, or t
  misc_feature (2176)..(2176): n is a, c, g, or t
  misc_feature (2212)..(2212): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaaggccctcaccccgccccgcaggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338092 - DNA, 1730 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctgggtgagtctgagctgctgggcttggggagctccatggcggggcctcccctcctccctcgggtctcctcctgctggtgcgggacggggggctgtgcaggaagcactggggtctgccccgccccaggcacgcttcccagggctggggtcctggatgggtttcctaagaatgggcagggccaggaagcaggccaggcctcagcaatggagccagctggggcagggcccagggggtggcctgggcggggctcccggctccctgattcacccacccgcagaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggtgaggcctgggcggcaagcagggggcaggccagccgtgcctttccaggcaggagag

SEQ ID NO: 338093 - DNA, 2511 bp, Homo sapiens
  misc_feature (2103)..(2103): n is a, c, g, or t
  misc_feature (2110)..(2110): n is a, c, g, or t
  misc_feature (2146)..(2146): n is a, c, g, or t
aagaaccgatgtttggcgacactgcgatctaactttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338094 - DNA, 1864 bp, Homo sapiens
  misc_feature (1456)..(1456): n is a, c, g, or t
  misc_feature (1463)..(1463): n is a, c, g, or t
  misc_feature (1499)..(1499): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338095 - DNA, 1310 bp, Homo sapiens
  misc_feature (902)..(902): n is a, c, g, or t
  misc_feature (909)..(909): n is a, c, g, or t
  misc_feature (945)..(945): n is a, c, g, or t
gcggccgccgctgtcacagaactgtaggaagacgggcgcgcggctcgagttgtgccgcacttccacacgcaggatgccctcacgcggccacttgtcacgcacgtgctccaggcagttgatgggcgagcgggagaagacgatgtggatgtaggccaggacgaagagcacaaacagaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338096 - DNA, 1480 bp, Homo sapiens
  misc_feature (1072)..(1072): n is a, c, g, or t
  misc_feature (1079)..(1079): n is a, c, g, or t
  misc_feature (1115)..(1115): n is a, c, g, or t
tctttcagaagggcctccagttcccgcttgactttgcccacaacgggtggcccccagaaggtgagggccgtgtacagctgcaccagggaggcccctgcccggatcttctccagcgcgtcctgcccgctgctgcggtactcacaccaccagatcttcgtcttcatcgcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcaggtccgcatccaggagatgctgcttcaggcgccgccactgggccccgggacccccacggcgctgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338097 - DNA, 987 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcgtgccgatgacatgaacaagcaactcgggcgccggtacagcgctgatctgcggcagccccgactggccgttcgctggcagcggagtccggcgggagggccagtctgtgcgggggctagggaaatgcgtgtactggtgtggaaccggacaaaaaggctcggcgagaggccgagggacaagcgggctggggaccctgagccgggaagggcagaagaccggagaggcgagagacgaggacggagaaggggcgcgcgtgcgcggt

SEQ ID NO: 338098 - DNA, 291 bp, Homo sapiens
gaggaagagagaagcgtacgtggtgcggaatacggcgggtcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgtcttctatctctaccaccctagtgccgaaatc

SEQ ID NO: 338099 - DNA, 3116 bp, Homo sapiens
  misc_feature (2708)..(2708): n is a, c, g, or t
  misc_feature (2715)..(2715): n is a, c, g, or t
  misc_feature (2751)..(2751): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338100 - DNA, 2812 bp, Homo sapiens
  misc_feature (2447)..(2447): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338101 - DNA, 1960 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcggccaaaccagtcactcggggaggaatgcggaggagcgctcattccattctatttaattgcagtgtacaaaattgtgtttgtatatagaataaactgtctgttgacagcg

SEQ ID NO: 338102 - DNA, 3305 bp, Homo sapiens
  misc_feature (2897)..(2897): n is a, c, g, or t
  misc_feature (2904)..(2904): n is a, c, g, or t
  misc_feature (2940)..(2940): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctgggtgagtctgagctgctgggcttggggagctccatggcggggcctcccctcctccctcgggtctcctcctgctggtgcgggacggggggctgtgcaggaagcactggggctcccggctccctgattcacccacccgcagaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338103 - DNA, 1431 bp, Homo sapiens
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgtcttctatctctaccaccctagtgccgaaatc

SEQ ID NO: 338104 - DNA, 3185 bp, Homo sapiens
  misc_feature (2777)..(2777): n is a, c, g, or t
  misc_feature (2784)..(2784): n is a, c, g, or t
  misc_feature (2820)..(2820): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcacgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaaggtccctggtcgcccacagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338105 - DNA, 3280 bp, Homo sapiens
  misc_feature (2872)..(2872): n is a, c, g, or t
  misc_feature (2879)..(2879): n is a, c, g, or t
  misc_feature (2915)..(2915): n is a, c, g, or t
ggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaagtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctgggtgagtctgagctgctgggcttggggagctccatggcggggcctcccctcctccctcgggtctcctcctgctggtgcgggacggggggctgtgcaggaagcactggggtctgccccgccccaggcacgcttcccagggctggggtcctggatgggtttcctaagaatgggcagggccaggaagcaggccaggcctcagcaatggagccagctggggcagggcccagggggtggcctgggcggggctcccggctccctgattcacccacccgcagaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338106 - DNA, 1969 bp, Homo sapiens
  misc_feature (1561)..(1561): n is a, c, g, or t
  misc_feature (1568)..(1568): n is a, c, g, or t
  misc_feature (1604)..(1604): n is a, c, g, or t
cacatgcaggatatgaagaaaaaaagtgccattgagcacctggatgcccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338107 - DNA, 1546 bp, Homo sapiens
  misc_feature (1138)..(1138): n is a, c, g, or t
  misc_feature (1145)..(1145): n is a, c, g, or t
  misc_feature (1181)..(1181): n is a, c, g, or t
aaaaaaggcagcagctaccaagaaaccggctacagcccctgactctgccggccagccccccgccctgggccccgtctcgcccggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcctggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcgaaaaaaaaaaaaaacanaaaaaanaaaaaaaaaaaaaaaaaaaaaaaaaaaaaaaaaaanaaaaaaaaaaaaaaaaaaaaaaaaaaaaaaaaaaaaaaaaaaaaaagggggggggggggggcgtaaacacaacctcctcggacggggcacccacaatcgataggccaccgcccccagctctttctaagaagaaagacggcggccgccaccaccagaggcgagcagtcaaaacaagacgaagagcgccacgcggcgcgcgcgactcaaaaaccccacggtcgggggtgagaaaaaaccacagtcgcggatgaaactctggcagagaggaccaccccaatccggggggggggggaaacgaacgaggcggacccaccaccccagcaaatatcagcgcggcgaggaaaaaaacacacgcgggcggtcac

SEQ ID NO: 338108 - DNA, 338 bp, Homo sapiens
ctctcaaggtgctgggattacaggcgtgagccaccgtgcctggctattttttttctttgaaaagaagtcacatgaataagtcacatgattcaaaagtcaaaaagtatgaaaaaatttgcagtattaatctcccacccttgtgtccttggctatcctgttctcttggtaggaattttttaatgcttcaaattgatttatcatagctaaaagtcttatttctcttatactcttagaactttcaataaaatattggctgacaggtgatttctggatgtcaggaacatttctgattaggtaagcccttaagtgagaacatgtgctatttgttttttttttac

SEQ ID NO: 338109 - DNA, 720 bp, Homo sapiens
gatctaatggctcccttagctgatgagcattgtgtaaccatcaattgaatgggctgaacttaatataattaataggtttgcagcactcccacacctattataagatcatattttgacccatttttcatttcttctttataagcatttagatgtttatgtggcattcacattttaatattccttggatgaacatggcatcatatgattagaaaaccaaaattcatttttgatggctgttgtggtcagatcgtgtcctctaaaattcatgtgctggaaacttaatttctagtgttaacagtgccgagaggtaggggctttgggaaagtttaatggattaatgcccacatataagggcttgttggagggaatttgggctctttgttgccccttccatcctttctaccatgtgaggacgccacactcctcccctttggaagatgcagcaaacaaggtgccatcttggaagcaaagactaagctcttaccacacatcgaacctgttggtgccctgatcttggactcccagcctacagaactgtgaggaagttaagtttctgttatttataaaattaccaagtctcaggtattgtgttatagcagcataaatggactaagacaatgccaaaggtggcacttgccatagatctgctgtgatgatatcaactctttgctttccaggagttaaagctttggattctgatgggttgattttcttttgtgt

SEQ ID NO: 338110 - DNA, 387 bp, Homo sapiens
atcaactctttgctttccaggagttaaagctttggattctgatgggttgattttcttttgtgtggacccttgtactggttactatttaatagttcttttcttatcttaggccgggcgcgatggctcatgcctttaatcccagcactttgggaggccaaggcgggcgaatcacgaggtcaggagatcaagaccatcctggccaacgtggtgaaaccccgtctctactaaaaatacaaaaaattagccgggcgtggtggcgggcacctgtagtcccagctactcaggaggctgaggcagaatggcgtgaacccaggaggcggagcttgcagtgagccgagatggcgccactgcactccagcctgggtgacaaagcgagactttgtctca

SEQ ID NO: 338111 - DNA, 206 bp, Homo sapiens
aggttcaaggaaagagaggagagcatggccccaggtagctcagagggcaagtgccacacacatgaggaagggactgttttattaagctgtgtaaaaaatgagtcaatgtccagaatgcatccacgtacctccccttttgaggcctcctttaacagtgcatgtttctgactgttaattttttttttttttacaattgaggtattacc

SEQ ID NO: 338112 - DNA, 353 bp, Homo sapiens
caaggcttgtattatgatgggccatttgaaatggaaaaattatgagactaatgcctgtgctatctactaacagagctgtaaaaagatcacataagtatagtccggcagttaggaatatggactctgaagtcagaactgaatttcagaatcactttgtcacttactgccttgtattcctgagcaagaccctttacttttctgagcttcagtcacttcaagtgtagaaaggggagatggttataatattttctcttaggttggatggctatgcccattcagtaaacaaagttcattgactacctacttctagtggctggagataaatctgtttaaagggtagtccaatatactca

SEQ ID NO: 338113 - DNA, 392 bp, Homo sapiens
gtgatgcccccacctcggcctctcaaagtgctgggattacaggcgagagccacagcacccaggccctaaaccttatttttccatattctgaataatcttaaactctgttgactgagtttgggtaaaggtagtttgtttcatttaaatactggagaaatattattcagaaacaagtcctaacagtggcttgtaataaacttttcactgaggttaatgatgcctacatctacagaatattgatgaggcagaattgcctaagaagcacttagtataaaataaaataaaaccaagtaccaaaacatagtcaatttcctttgccctatcttataccactgagagttaaccagattggccatttggaatgttgattctcaaaaaaatgtaccttgata

SEQ ID NO: 338114 - DNA, 566 bp, Homo sapiens
gccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctac

SEQ ID NO: 338115 - DNA, 901 bp, Homo sapiens
gccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaacaacaaaaaaaaaaaacaaacaaaaaaaaaaaaaaaaaaaaaaaaaaaaaaaaaaaaaaaaaaaaaaaaaagagagcgcccacaccaacaacaataacagagaaggcggcggcgctgcgcgaagagcaaaaccaacgcaccagcacaggagagcagaggatagagaaaacaaacacaaccacacgagagcggaagacacaaggggcccagcgaacagggatgccagggtacaagaacggcccgaagaggagagcatagagacaacggacggcagcagggccactactatagagaacagaaaaaagaaaatggagaggatat

SEQ ID NO: 338116 - DNA, 788 bp, Homo sapiens
  misc_feature (648)..(648): n is a, c, g, or t
gccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaacaacaaaaaaaaaaaacaaacaaaaaaaaaaaaacccggggggcatatatatggggggggggcaaaanaagggtcataataaaagtggaccacggtggcaacacacgtgtctctcgagcacaggcttttgttctacacaggggggaaacacgggaggagcccacataagggggaccaaataactgcaaacgcggggttacccggaaat

SEQ ID NO: 338117 - DNA, 881 bp, Homo sapiens
gccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaacaacaaaaaaaaaaaacaaacaaaaaaaaaaaaaaaaaaaaaaaaaaaaaaaaaaaaaaaaaaaaaaaaaagagagcgcccacaccaacaacaataacagagaaggcggcggcgctgcgcgaagagcaaaaccaacgcaccagcacaggagagcagaggatagagaaaacaaacacaaccacacgagagcggaagacacaaggggcccagcgaacagggatgccagggtacaagaacggcccgaagaggagagcatagagacaacggacggcagcagggccactactatagagaacagaaaaaagaaaatggagaggatat

SEQ ID NO: 338118 - DNA, 999 bp, Homo sapiens
catgttgtccaagctggtcttgaactcctgacctcaagtgatccacccgcctcggctcccaaagtgctgggattacagatgtgagccaccacacctggctgtcttttcattattggtgtgaactcatgagttctcatattttccatagtttatcattcattactattctcactgttttcatacttgaattgtcccaaatttggcccatgagagccccctcagttgatgcttttgtatgcttctatcattttgggagattatttccttactttctagaataacaagatgttccgggtttactgtgtacctatcctgccttaattctagaatcagctctttctccaacaagctttggttcttcttagtggcgcatgatatgtattagagaccaagatacgggcactaggtatgggcattattactgggatgtctttgtttctgggccctttaagtagacagaggtagaaaatacatgcatgtattaatacatatactgacaccctagtatacacatatacaagtgttttctcagtcttggcacgattgacattttgggccaaataattccttattgtggggtcagtcttgtatagttttggttgttagcaacatctctggcttccacccactagatgctacaaagaaaattatctccagacattgccagtgtcaccagttgaaaactactgataagtacctacatgtccacatacttaactttagaaatcattaggctacagtgatgcttctaattctggtctgtccccacagaattctttatcttctctcataccatttatttgtatccctcttcttctatagtgagaactctgactcccaataatatcaatagattgattcacttcctcaattctgtaatataggatgagcagcccaagtccagaaatccaaaatgcttcaaaatctgaaactttttgagtgccaacatgacactacaagtggacagttccacacctgactgaccccatgtgacaagtt

SEQ ID NO: 338119 - DNA, 636 bp, Homo sapiens
catgttgtccaagctggtcttgaactcctgacctcaagtgatccacccgcctcggctcccaaagtgctgggattacagatgtgagccaccacacctggctgtcttttcattattggtgtgaactcatgagttctcatattttccatagtttatcattcattactattctcactgttttcatacttgaattgtcccaaataattccttattgtggggtcagtcttgtatagttttggttgttagcaacatctctggcttccacccactagatgctacaaagaaaattatctccagacattgccagtgtcaccagttgaaaactactgataagtacctacatgtccacatacttaactttagaaatcattaggctacagtgatgcttctaattctggtctgtccccacagaattctttatcttctctcataccatttatttgtatccctcttcttctatagtgagaactctgactcccaataatatcaatagattgattcacttcctcaattctgtaatataggatgagcagcccaagtccagaaatccaaaatgcttcaaaatctgaaactttttgagtgccaacatgacactacaagtggacagttccacacctgactgaccccatgtgacaagtt

SEQ ID NO: 338120 - DNA, 900 bp, Homo sapiens
acattgtctacagtcactcagaatggtccagtgtatgacatacaatcatcagctttcctacaacacagccttcaacagaaatagggtgtcccaagcccctggcaatagaactgtttaccaaccaagaaggttgggaaaggcacaagattggcatgtggcatgtgcccagacagacttcgaggggtttgtgccgtgagatttaaagttcttataatgctgtctacaatgaaaaaaacatgtcagcagggcctatcgtggtccaatgtgtgctaaatgaatccatgacaggatcaagggtgccttccttatcaagaagcagaaaatcattgtgaaagtgttgaaagcacaagcacagagtcaaaaagctaaatttggcggggcgcggtggctcaggcctgtaatcccagcactttgggaggctgaggcgggcggatcatgaggtaaggagatcaagatcatcttggccaacatggagaaaccctgtctactaaaatacagaaaattagcccagcatggtggcatgcgcctgtagtcccagctgctcgggaggctgaggcaggggaatcgcttgaacccgggaggcggagattgcagagagccgagatcgtgccactgcactccagcctggcaacagaataagactctgtatcaaaaaaaaaaaaaaaaaaaaaaaagctaaatttaaaaatgaaacttactggaataaacaattcatttcaaaaaaacgtaaagctacaaatttacatagcccagctatgtcctttctaaagataaggaaaagctaagccttcgatatgtgcctacaattcagggataatatatgaagcttagaatttattaggggagataaggctcattacacgtgaaacaaagagcacaagcactcacagtatacaatga

SEQ ID NO: 338121 - DNA, 834 bp, Homo sapiens
gtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcatttttggaactggaaatatagcttctattaacagcttgatcttgcctctgtctatgctttctgactgtgttcagtccttttatgatgggagccctgatgatgtggaagattttaatccccttttgttcttgttatgtgtgcttttgaagcagttcagttgactactcagttatcgtcaaaaagcctttttctcattggttctcgtcatatcagacattatggtttgcattttttcttcttggtcacggattatggcagtgggttgatattgggacaaggcatcacgccactagtgattgtcatgtgccagtgaccaccttttgggggttcctctcaaaggcctggcccagcggtcccacacaggaaagaaatcaggaactagtgtgggaagccccaaaggtccttcatgggaacggtggggggaacaccataacgcattcgggcacggaatccactatcaagaacaatcactcagggccacagacaaggcacgggaatgacacacacccgggaggaacagcttcgaccacaagcgaattgcacaacacacattcagaggcgagaaaaagaatcaacggacaacaggagaacataatagaggacaccgagaaacacaacgctcc

SEQ ID NO: 338122 - DNA, 279 bp, Homo sapiens
cagctgtgctccttcagccccagaataacatacgtgtgacagaccaggattcagcccacagcctggagccaagacaccatccgacccagatgaacctgcgtggatcacctgagccactagtgacccagagatcctgagagtgaaaaacatgcatggtcctatacaccactgagttttgggatgacttgttacttagcactattatgacaattgctgactaatataccaggctcctggaagatttgttgtgaggttctcataaaatgatgaatgtgaaat

SEQ ID NO: 338123 - DNA, 336 bp, Homo sapiens
  misc_feature (155)..(155): n is a, c, g, or t
  misc_feature (190)..(190): n is a, c, g, or t
  misc_feature (222)..(222): n is a, c, g, or t
aatttcaagtagagtttgaagagaataaagagtccagaaatgtgggatctgatggggctggaaaagccaccttcgtttatcaccctacacagtaggagataaccctgctgctcaaaagatttaataaaaaatgtccattaagaattctcagctgngtgaatgttggttatgatgcatgaccacaccttantgtgctcctggtcagctcctaactttgagaanacacagataggaaggcccatgtcccacgcacaagacaaccagctcgaagcagggacaggcaatgagagctgaaagagacctagtactacagctgtctcatctgggtgcaacttg

SEQ ID NO: 338124 - DNA, 989 bp, Homo sapiens
cggatttcagccaggctgtgccacggagggcagaggccacccaggaggaggccccacagccacttgcagggagctgctttgctgagagtctctgtcctctgcatctggagagcttggctcagagctgaggcaggagggagggctccctgtctgggcctcctccaggaactaaagtccctttccgggaattgaccaaactgcaggcttgcccagggaggacatgctgtgtcctagttcagctcgaggggcagtatccagcttcaaccctcagcggatgccccagacaagattccgagccaggccaacaacgcctaaggaggacgagaccctgggtgtagctcatcagaggtgtcaggtgtggtctgaggccccagctctctctgccctcctgctcctctgctctgtgctggctcctggtccttatggctcatgatgttgagacagctgccctggcctagggggtcacacactgaacaaagcaggaagaaggggaaggggagccctccttctatcacccttatcccttacagcaagaagcacccagaaacccctcagcacactcccctagtgcctctattggcctcactgtcaccatggttgcatgggggccccagacaatagacacctggatgcaagatccctaagacagaggcaggaaataggaagagggaggtgagaggctttcgatgaggatgcttctacacatgaccttgaggatgaaaacgcatcagggggtcccgggaaccactgcgttgttaacataaagtctgggagcaaagaccagcggctggaatggatgtgcctgggagccagctgaaacagatgcagccgaagccacagtaaagaagaaagagataggggcctgcttggagccaacccctacctttgaggggcctgacagggccacctcacagctgcctgggcttgttgttgcctcctcactacagaaaccatggaagtctctagagtcagtgtttccaggctggggc

SEQ ID NO: 338125 - DNA, 456 bp, Homo sapiens
agtctgggagcaaagaccagcggctggaatggatgtgcctgggagccagctgaaacagatgcagccgaagccacagtaaagaagaaagagataggggcctgcttggagccaacccctacctttgaggggcctgacagggccacctcacagctgcctgggcttgttgttgcctcctcactacagaaaccatggaagtctctagagtcagtgtttccaggctggggctgccagatcactcctgtaggtggttgaaccagttgagttcattcttctcagtgagggggacacaggtggaggtccatcggcacctccataaggggtgcgagaaggaacctgttagaatatctgggttctggctgggtgattggcaggagggcctatgaaatggagcccactctggattgggtgttgcagaaagtggggggcaagtctaccagtgggtatctcagcaaatct

SEQ ID NO: 338126 - DNA, 129 bp, Homo sapiens
ggtctgcttctgcatgaactcccccagatccgtgtttgctgctggtcctcacagcaggctcttcgtttctggaccagatgtcttttctgtgcttcagaaccatctagaaaaaagggaactggatatctc

SEQ ID NO: 338127 - DNA, 515 bp, Homo sapiens
gggaccatcttaaaagtctgcctaccataaactgcagcctgaaagcttaagacgaggcaaaggaagagggtgagaatgcaggtacaactgataatctgatataaggaaataacattaaaaagcagggagaagaaattatgcatgattggacttgccttcacaggaaccagcatagtaactggcacatattactagacaagtgaataaaccaacataccaaatattatcaaattaaacaagcaagtatttactaaagagcttatatgcttatagctacaagagaaaagaaattacttataatgctaagccactaggtagaattgagaggtgacataccagggcagacaatatggacaaaaaactaaatttgacataaagaaaactgcgttaagatatctttgagatcttggaaagtgaccaaatggaagcaaccaaatcaaataattccaagggccttagttttgcctcatctgtaacggagttgatttaactacttaatctttaagatccctttc

SEQ ID NO: 338128 - DNA, 405 bp, Homo sapiens
gaaaattcacaaatacgtggaaattaacacgcacctgaacaaccaataggtcaaataggaaatcaaaaggcgtattagaaaatatcttgttcccataactgcgtgcgctctcccctcccattctctttccgccatctttccgcattgccacaatggtgctcatgaatgtcctggctgatgctctcaaaagtatcaacatgcagaaaagagaggcaaacgccaggttcttattaggtcatgctccaaagtcatcatccagcttctcagtgtgatgatgaagtgtggttacactggcaaatttgaaatcactgatgatcacagagctggaaaaattgttgtgaacctcacaggcaggctaaacaagtgtggagtgatcagcccagatttgatgtgcaactcaaaggt

SEQ ID NO: 338129 - DNA, 531 bp, Homo sapiens
actggcccaggtgcttgccttataataggatggggagcatttatcatttgcccactgaacttgctgatgaggaatgtcattatctgagtctctctacagttttctgttggcttcacatgcagagcaaagcaaatctttcttagctctggcggtgggacctctttggaaggcagggggaggagacagacaggacaaggtggacactgtagtcagtcttaagtagtaatgtacaaaagtgcatgctaagtgtctacaggcactttgaggtcactttgccctggaaaatccccatggattgctttagtcagagagtatgctagtagtgcaggtgtgtttcatatgatggaattattgacttaaaaatcttttcaagttttacttacgcatgtaagcactgaaatactgacgctttttagtttggtagtgtggtcactcattaaattatttgagcattttatatactgctctcagcaataattctctcaccggtctctttgaactacctctcacagcctgcactgagtttgggtt

SEQ ID NO: 338130 - DNA, 280 bp, Homo sapiens
ggcagccacattcattaaagacactttagtaaagctcaaagcacacattgcacctcacacaataacagtgggagacttcaacacaccactttcatcaatggacagatcgtggaaacagaaactaaacagggacacagtgaaactaacaaaagtaatgaaacaaatggacttaacagttatcaacagaacattttgtcctaaaacaaaaggatataccttcttctcagcacctcatgggaccttttccaaaattgaccatatacttggtcacaaaacaggc

SEQ ID NO: 338131 - DNA, 146 bp, Homo sapiens
tgtcttggacccttctctcgcaagagctagtccaaaggctctgaagtgataccatgggaaggaagagctttttggaggcagaacctgctcatcaacactctgctattctcctgggatatcagacaaaagccagagctttctgtgca

SEQ ID NO: 338132 - DNA, 227 bp, Homo sapiens
ccacagccaggtcagaagtgggggagggggcatggaagacaaagtaaagaaacttggaaacgctcacccttccgggagagtgggatggtcacagagccctgtgtaggtagatcctggtgaacacaggatgtggacaagggcaggaagataaggctagaacagtaaccaggagcaacatgaaggagtttccattttattataaacataaatgatgactagagtgttag

SEQ ID NO: 338133 - DNA, 224 bp, Homo sapiens
tccatgaggaaagtattactattgtgcatatggggaaactgagacacagagagattaagttacctgctgaagatcatgcagctcctgaaggcagaaccaagatccaaacctgatggtcttggtacaaagtccatggtctaattaagagctacacttcaggccaggcacggtggctcacgcctgtaatcccaacactttaggaggccgaggtgggtggatcgcct

SEQ ID NO: 338134 - DNA, 748 bp, Homo sapiens
tattgccaagtttccctccagaaggattttacctgtttggctgtcaccaggagcgcatgagacctcctgccgctctgcacagctgtctgtaggttattgagggttacactttttagttctttgcctatttggtaggtaaaaatggtatttccttatttgtttttgtttttttcttttctttttttttttttctgtttggagtaggctgctgcttttgtacttgtttgactactttctctccctcttcacccccacctcatgtcccaactcatatttctctgattttcaaccattttcatttgtaagagctctttatatatatcatgagactactgccccttctcttatatgtcacatatctttttcctagtttatctttaattttgtaactttgtggttatgtgtatatgattgcatgatcaaatatgtccattttttttacattctctctcattgctttaatgattaagaaatgccagcccctgcctttctttcttgttttttaatggcttcatttaaaaataattattctttaatttattggaattcatttttttaaatgcaaggtaggaataaaatgtattttttcccaaatattttacctgttattctgaaatctaaaagtaagttgattgaagcgcccacttttcttcatggatttgtaattatatgaagttaggttttagaaaagttggtaggatactaatgggtgctagggtaacgtgtgggcaatgctaggattattaag

SEQ ID NO: 338135 - DNA, 628 bp, Homo sapiens
ctgaggatcccgcacacgccgaaggcccatactgagcagatcttaatggacgaagttgttgctgcacacgccgagtgaccatacatacacagatcgctgtggacgaagttgttgcaaatctgaatggacgaagttattgcgtccagactcatatttctctgattttcaaccattttcatttgtaagagctctttatatatatcatgagactactgccccttctcttatatgtcacatatctttttcctagtttatctttaattttgtaactttgtggttatgtgtatatgattgcatgatcaaatatgtccattttttttacattctctctcattgctttaatgattaagaaatgccagcccctgcctttctttcttgttttttaatggcttcatttaaaaataattattctttaatttattggaattcatttttttaaatgcaaggtaggaataaaatgtattttttcccaaatattttacctgttattctgaaatctaaaagtaagttgattgaagcgcccacttttcttcatggatttgtaattatatgaagttaggttttagaaaagttggtaggatactaatgggtgctagggtaacgtgtgggcaatgctaggattattaag

SEQ ID NO: 338136 - DNA, 388 bp, Homo sapiens
tctgttgcccaggctggagtgatcatggctcactgctgcctcaaactcccaggctcatgcgatcccaagtagctggggctacaggcatgtgccaccacacctggctaatttttatttgtatttttgtagaaacaagttttcccccaggttgcctaggctggtctcaaactcctgggcttaagcgatcctccagcctcggcctcccaaaatgctgggattacaggcatgaaggttgcagtgagttgagatcatgccattgcactacagcctgggtgacagtaagattccacctcaaaaaacaacaacaaaaaaaggaaataccaaacaaaatgtgcttttccctatcttcgaaatcatcatgtcttttcattcctgtatggcaaaaaat

SEQ ID NO: 338137 - DNA, 449 bp, Homo sapiens
atgtgctcagggttccatgtagataagtagatgctcattcagaagagagaccaaggcccctctgacaccgaggccaggcgctgggccaccgtgcttctctgcctccaggagctcatgcgctggtccctgatgagagggtgtggctggcttcataggaatgatctgattgtgtgtacattttttgaggaaagatttttgcccactcagagatgatctctgagctcttgggagagtggcgtctaagcagtcggtggaatgttccataggtccctcccggggaggcttgtgcggcagtgcctggtgtgtgattcctggtgaggtcccttcccttgacatgagagcagagcaaaaagagccggctcttcgctcccccaacacagagatcccgctggaagggcgagttgttgaggaggaggaggaattctcccaggaggaggaggaattcgccc

SEQ ID NO: 338138 - DNA, 537 bp, Homo sapiens
agaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggaggtgagttgttgaggcatggagtaac

SEQ ID NO: 338139 - DNA, 1710 bp, Homo sapiens
agctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338140 - DNA, 2566 bp, Homo sapiens
cctatagagatgaggtttcattatgttgcccaggctggttttaaacttctgagctcaagtgatcctcccaccttggcctcccgaagtgctaggattacaagtgtgagccatcatgcctagccagtttgcagattttcaatacctgtacacctacatgccagtaaatataggaatccttttcagaacctaagtggtaggaaccatcatcatgtttacaggtgaggaaactgaggctcagaaaggcagtcacttctgcaggtctcagagatggtcagggtttcacttcttatctctctgagatgaatagagtttctgacccctgtcctcatcccgtgggtcttgagcttgtagccactgtgccttgtgcatagcctcacgtgtagcaggtggtcaggactgtcactagacttgaaggcagagctctccaggtggccccaccgaagtttgcaccaccacacgcagcaccagggcaccacctcagtgggagtaccactttccatggtggcagggttggtcggaggggggggtgtttggggttgtggcttagcacctgtgaggccccatccagaggactaagtcatatgagatccctggaattggggctcgctctcaggtcaggatgattaggcgatgaccacccacctgtagtacaggtaccaggaagagaagagtgggtaaggtaaggaaatcctagggagtgagggagagccccagggatttggaggcctggcacccacaggcctggcaccactttggtgggggaggagcctgcctgtgatcacgagctcttgctctaacacctgtattgctttctccagtctgaatcagaccacgtaattcccttggcatccagcacatgagcagagctggccctgaatctgtagggtaccacctgagggctctctgggcagtcagggtgggtggattctgcccccgtggggagtccttggcagtgtgggctttcatgggcagaagccaggaccaggggagaggattccagccctgcatgttgggggctatgattcctgggcctgggtgtcctcctctttcctgactgcaaagggtgctgtgttcctcctcccgcaacccctaagcaggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaaggtgtctctggggtctggggtgtcacataggcgtaggcaccctctgtggtggttggggagccccagggccatgggtacaatgcccaggggcatctctgaccatcacttttccccatgtgattgcagaggcagaaagataatctcgaactcccgtcagcagagcaccaggccatcgagagcagccaggccagtgtggagacctggaagtacaaggccaagaattccctcatgtactatccagagggtaagtggcgggcctcgcagccaaatggggaggtgttgggtagagctgtgtgtgtctggctgtgtttggagcagccttccaggtgtgtatggccgtgcccccttgcagtttgggcttctgatgggtactggtctgtctaagggtggacaggtctgtgtgaggtcagcagtgagtgagaccctctccagcggcactggggcctgcgttctgctcaatgcttttgttcatctgggagtgacttggccgagaagcgagctcctcatgctccttaggctgctgcccttctgacacctgctgctacctttgcttcgtctgccaggtgtccctgacgaggagcagctgtttaagaagccccggcaggtggtacataagaacacgcgcttccttagggaccccttcagccaagccctgagcaggtgccagctccagcaggcagccgccctcaatgcccaggtgagcaggcgggtcagcagggccgcatgggccaggttggacagggctgcctgggggcaggcatgatctctcccatctctttgagcttggcagagctcagtgagtggaaccatctggggccctgtgcggcaggatcctgagtctttccttggccccagtgggcttccattgaacactgccttggtcacacacgttctgtaggtccagatctgtgccagctcccttgatggcaggggcaggagagaaaagggactgctgggagtgagcccaggctggcagctgcacgcccacacaccgggcagggaagccagagagccgcagagggagcccagccccagggggtggctggggtgggacaggccctgggttggcagagagcagaggctttctgagtctgggagcaagacgagtagatactctctgatggtgactgtggcagtcacagggttgaagtggggaaggcaggaagagactagagcataagcattgcctgtcatcagcattgcctgtcatcagcattgccccctgcaggggcctggcgtcagcatcctctggagttgctgggataggcgcagctcgagtggaggccctggcacctccctg

SEQ ID NO: 338141 - DNA, 2029 bp, Homo sapiens
agctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtaagtggcgggcctcgcagccaaatggggaggtgttgggtagagctgtgtgtgtctggctgtgtttggagcagccttccaggtgtgtatggccgtgcccccttgcagtttgggcttctgatgggtactggtctgtctaagggtggacaggtctgtgtgaggtcagcagtgagtgagaccctctccagcggcactggggcctgcgttctgctcaatgcttttgttcatctgggagtgacttggccgagaagcgagctcctcatgctccttaggctgctgcccttctgacacctgctgctacctttgcttcgtctgccaggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338142 - DNA, 1677 bp, Homo sapiens
tccgtcactctccgcaaggcgcttgaattcaagcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338143 - DNA, 2159 bp, Homo sapiens
agctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaagtaaacagggcagaggaagacgtctgtggtggaagaggctgtagtagtgttgtcagggaaaagagagagcggctctctttgtatgggacgggggtcagggaaagaagattttctgttaaagtgtgagtaggagtttgacaaactggaaggatggtggcaaagagggctttctaaagagcggtggcagcaagtgtgaatgctggggttcctggaaagagaccgcagttgtgacagcatctcgagtgagtggacctgcgtcgccccaccacacgcacacagaaggaggagctgaaacggggattggcggaaggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338144 - DNA, 1646 bp, Homo sapiens
agctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaaaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338145 - DNA, 903 bp, Homo sapiens
ttttcctgagagattgtcagaggtcatggttttgggaggaacacgaagacaggtgaggagtgctgcgccttgggcaggtcaggtggggtttggggctttccaggggcttttagtgggaggtgatgggttgtgggggttttgtaggcaacaaagagaggctggcacccaccacagtggctttctgtgtgaggggctgcctggcgtgtggcaggcctggcgcagctacccacacacctgctaccttgtagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338146 - DNA, 647 bp, Homo sapiens
tccgtcactctccgcaaggcgcttgaattcaagcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaagtaaacagggcagaggaagacgtctgtggtggaagaggctgtagtagtgttgtcagggaaaagagagagcggacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338147 - DNA, 492 bp, Homo sapiens
ttttcctgagagattgtcagaggtcatggttttgggaggaacacgaagacaggtgaggagtgctgcgccttgggcaggtcaggtggggtttggggctttccaggggcttttagtgggaggtgatgggttgtgggggttttgtaggcaacaaagagaggctggcacccaccacagtggctttctgtgtgaggggctgcctggcgtgtggcaggcctggcgcagctacccacacacctgctaccttgtagatcctggagccaggccgcagggaacggctgggtctgaagatggccaacgaggccgctgccaagaaccgggccaagaagcaggaagccttgcggagagtgacggagaatctggccaggtgaggggccgcctggctggtggggaagtgcgagggtggctctggcctgctcctgttcggcccctgccctgaccgtgtggaggcatggcccacgcggcagagtccagggcaggtccgcggggttctgc

SEQ ID NO: 338148 - DNA, 2311 bp, Homo sapiens
agctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacagaaaaaaaaaaaaaaaaaaactctcgaaacttagttccttcttcttctccccgctcctgtggcggggttggttctctctctgtggagaccagggttctctttttattccttccgtccgcctttcttcttccttacactataagttgcgttgccgccacccgatgtggaaggatttcagactggacattggaccattgagcccccctgtgaggccccaagaaactattcttttcacggctgtgtagacctataaagggcccgaccaaacgattatattcactttaaagggggtggatatacatctgattgaaaattgaggcacccaagtgtatatctcttttgacaaacgggctcagttctaagggaggcttggttgcactgcggattagagtttgcccatttgtttgacagcagaggcaattagatttcgaaaggcagctccaatttcaaggtaacaccttggcacacttttgaaacttgttcttgtccagcacaaggggttcccatggggggcttggaataaaacccaaccggtgggtcttagggtcgatctgtggtccacgggcccagtgattttagtggacagccttagtagctggcag

SEQ ID NO: 338149 - DNA, 2092 bp, Homo sapiens
agctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaagtaaacagggcagaggaagacgtctgtggtggaagaggctgtagtagtgttgtcagggaaaagagagagcggctctctttgtatgggacgggggtcagggaaagaagattttctgttaaagtgtgagtaggagtttgacaaactggaaggatggtggcaaagagggctttctaaagagcggtggcagcaagtgtgaatgctggggttcctggaaagagaccgcagttgtgacagcatctcgaggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338150 - DNA, 2387 bp, Homo sapiens
cctatagagatgaggtttcattatgttgcccaggctggttttaaacttctgagctcaagtgatcctcccaccttggcctcccgaagtgctaggattacaagtgtgagccatcatgcctagccagtttgcagattttcaatacctgtacacctacatgccagtaaatataggaatccttttcagaacctaagtggtaggaaccatcatcatgtttacaggtgaggaaactgaggctcagaaaggcagtcacttctgcaggtctcagagatggtcagggtttcacttcttatctctctgagatgaatagagtttctgacccctgtcctcatcccgtgggtcttgagcttgtagccactgtgccttgtgcatagcctcacgtgtagcaggtggtcaggactgtcactagacttgaaggcagagctctccaggtggccccaccgaagtttgcaccaccacacgcagcaccagggcaccacctcagtgggagtaccactttccatggtggcagggttggtcggaggggggggtgtttggggttgtggcttagcacctgtgaggccccatccagaggactaagtcatatgagatccctggaattggggctcgctctcaggtcaggatgattaggcgatgaccacccacctgtagtacaggtaccaggaagagaagagtgggtaaggtaaggaaatcctagggagtgagggagagccccagggatttggaggcctggcacccacaggcctggcaccactttggtgggggaggagcctgcctgtgatcacgagctcttgctctaacacctgtattgctttctccagtctgaatcagaccacgtaattcccttggcatccagcacatgagcagagctggccctgaatctgtagggtaccacctgagggctctctgggcagtcagggtgggtggattctgcccccgtggggagtccttggcagtgtgggctttcatgggcagaagccaggaccaggggagaggattccagccctgcatgttgggggctatgattcctgggcctgggtgtcctcctctttcctgactgcaaagggtgctgtgttcctcctcccgcaacccctaagcaggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338151 - DNA, 575 bp, Homo sapiens
tccgtcactctccgcaaggcgcttgaattcaagcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaaacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 338152 - DNA, 121 bp, Homo sapiens
tgctcaggctgtcaattcatcatgcatttacactcaagtctcgtgacagatttaggtagggcctgaacaaaactcaggacaccaagagcctcaaggcttgaattgcccatttcttcctttt

SEQ ID NO: 338153 - DNA, 207 bp, Homo sapiens
cgtgttggggagatattagaggccttcgagcaggagcgtgacatgttctgatgtacatttaaagatcaccatggctgctgagtgactaacagactgcgtggaggattcttattcacaccaggagccctagaagcctctgatgaaaacacagggattatatcttgcagacatttttacttacaagggtttggacaaaagcggttgaag

SEQ ID NO: 338154 - DNA, 215 bp, Homo sapiens
gctttaggatgaggaagtggaagcaggggaaagtcaggaagtatggctttttaaaggagagtctagggctgggatatagtagcagagccacctggtttcagtccttgtatcccaaagatcttggggcacacgaacctgggccatcccatgggaaatacattagtccttcccattacatgtggctagtgtgagttaatagaggagtgttgtacatc

SEQ ID NO: 338155 - DNA, 659 bp, Homo sapiens
tggactcagtgagtgtggaggacagggagggaagcatctgtctgccacatagagaaggcaccttgcacacagtaggcactttcctgagggtggccgtgaatgtgaatgttacctgtgaaatagaggtatctagacagagaagttggcccttgtgttttgttgtgtgattgtcttttgccatgatgggccatcagatgtttttgagtagagagtaacttaaatggaatttgtttaggataataaccccattggcagaacagccgggaggcaaggttagagagtaaagtgataaggcctgaactttaggacggaaaagagtaggccagtgttggaagcattttggaggaagcagcagcagtcatgattgcttgactgggcagtggaagagaaaggggtttagaatggctcccagctttctagcttaggttagggattgtggcgataccatctcctgaggcaggaaacaggtgagagagagcaggtttggaaggataaggagttcagctttggctctgaggactgagtgacagagctgcctcagtggtgaggcgcggcaggcagctggatatgaattttgacctcgggaaagacatctgtgaaggtgaagactctcactcactcatcccactcctggcccaggtcttctgctttgttctccc

SEQ ID NO: 338156 - DNA, 330 bp, Homo sapiens
ccgagattgcaccactgcactccagcctggctgacagagcaagactccatctcaaaaaaagaaaaaaaaaatcaagacccaatctattattaagaagcaagtagagaaggaaataacacagaggactcaaacatcaaattgacagtctgatcagaagactattgcagtcctttccaactttgacattcaatgattccatgatcagcaaacattcacaagaaaacatatgggcacaccagaagctgagttaaggaaagccagctaaagatcaaaagtgattagattagacacactcaaataagtgagggggaacagtgaaccatcaaatta

SEQ ID NO: 338157 - DNA, 730 bp, Homo sapiens
aaaaatggaaaaaaaatttagtcaaaaaatattactggtataaagacatgaattcctctgtgaaagagtcttaggtacttgcagagggtgggagtaatgaccatggtcataaagatgtggcaaaaggaaatgtgaggttctgattcaaactgcccccaaatactaggtctgggcatcggcctccccactcatggggcagccaggcctcaatctgcctcttgtctctgcaggataatgaccgtgaacaggcatcagcaaactttttctgtaaaggtccagagagtaaatattttgagctttatggaccatagggtttcagttgcaactgcagtaaattctcaattaatgtcctcgttaggttcttagaaactgcaactttaagcgaaatgacgtacagtaagtccaagtaacgtcgtttcttgtaatgttgatgagaaactgccactgtagagtaaaagcagccgtagatggtatgtaaacaaatgagtatatctgggttccaataaagctttatggacactgaagttttgaatttcacataatttttctgtgtcacaaaatattattctttaaacatttttttcaaccatttaaaaatgtaaaagctggccaggcatggtggctcatatctgtgatcccaggactttggaagaccaaggagggaggattgcttggggccaggagttcaagaccagcctgggcaacatagcaagacccccatctctacaaa

SEQ ID NO: 338158 - DNA, 346 bp, Homo sapiens
tgttggggtcaagaggtagagcatcaagatcagtagctaattcctgcggggcttaatatctaggtgatggattgacaggtgcagcaaaccatcatggcacacgtttacctatgtaacaaacctgcacatctcacacatgtaatctagaccttaagataattttttttaaaaaaattaccttatgttttagtttcttaatcagaatattcattttcagttgatctgtttttaagtctccatggcaatcgaagtcttcatttccaaatacacttaacacatttattgtcatttccaggagtttcttatatctgcagaaacgtacagaattagtaagtcaaatattttt

SEQ ID NO: 338159 - DNA, 250 bp, Homo sapiens
tgacccccatcacctacaccccatcacctacacctcaatcatctataccccatcacctacacctcgatcatctataccccatcacctacacctcaatcatctataccccatcacctacaccttgatcatctataccccatcacctacatctcgatcatctatatcccaatcatctacaccccatcacctacaacctgatcacctataccccgatcacctacaacctgatcatctataccccatcacctat

SEQ ID NO: 338160 - DNA, 396 bp, Homo sapiens
ccaattttacggtattctaagtaacgctaactgaactctaacagtatttagacaattagtgaaaatcaagtgagagaaggagtcagaaaccatgagaccgtgagagttgccctcaaaggtctgctgcttctcccttctcctgttccctcctctcctcactggagcctgggggaactggtcttggaggaggccatctctctgtcaccctcaaaaggtggtgatgtcccagggaaagaccctttctttcacccacccagtatggagctctcctaggaaattttcaaattctcttaggatgctctaagctgctgcttgggctgtgcagctgcccacacccagactgtctcttccagcagactgtggatcatgcaagcaggagtatgacgagtccggccc

SEQ ID NO: 338161 - DNA, 430 bp, Homo sapiens
ccaattttacggtattctaagtaacgctaactgaactctaacagtatttagacaattagtgaaaatcaagtgagagaaggagtcagaaaccatgagaccgtgagagttgccctcaaaggtctgctgcttctcccttctcctgttccctcctctcctcactggagcctgggggaactggtcttggaggaggccatctctctgtcaccctcaaaaggtggtgatgtcccagggaaagaccctttctttcacccacccagtatggagctctcctaggaaattttcaaattctcttaggatgctctaagctgctgcttgggctgtgcagctgcccacacccagactgtccttggacaagctttctaccttctctgtacctcagtttgtccatctgtctggtggtgatcagagccattgctgccactgagtgtct

SEQ ID NO: 338162 - DNA, 248 bp, Homo sapiens
aggacgaggtgggaggatcacttgagcccaggaacttgtggccagcctgggcaacaaaagaagaccccatttggccaacatggccaacctggccaccacggtgaaactctgactctacaaaaatgatctgggcatgggtgacatgcatgtgtagtcccagctacttgggaggttgagatgggaggattgcttgatctcagaaggccaaagctatagtgagctatgatcacatcactgcactccagcct

SEQ ID NO: 338163 - DNA, 377 bp, Homo sapiens
ttggttcacctaagataaaaacttagaagtcatctttgattcatcatgccacttcattcttgtgttaatcatttgccaacacccatcagatttcccctatttgaaacgtgaactagtagaactgccttctccttgccctcctaatgccaagctctccaagccatcccaggcattgcttctgtctaacactcatctaataatactctttctatttgctttaccgttcgaaagtctgcaggttgggcgtggtggttcacgcctgtaatcccagcactttaggaggccaaggagcactttttgagtctcctgtctagatcattctcttcctcaccatcttctgtctctctctggtcttgacactttccctccccacaagc

SEQ ID NO: 338164 - DNA, 537 bp, Homo sapiens
ttggttcacctaagataaaaacttagaagtcatctttgattcatcatgccacttcattcttgtgttaatcatttgccaacacccatcagatttcccctatttgaaacgtgaactagtagaactgccttctccttgccctcctaatgccaagctctccaagccatcccaggcattgcttctgtctaacactcatctaataatactctttctatttgctttaccgttcgaaagtctgcaggttgggcgtggtggttcacgcctgtaatcccagcactttaggaggccaaggagggcagatcacgaggtgcagagatcaagaccatcctggctaacacggtgaaatcccgtctctactaaaaatacaaaaactagctgggcatggtggtgcacgcctgtaatcccagctagtgcctgtaatcccagctatttgggaggctgagacaggagaactgcttgaacctgagaggcagaggttgcagtgagccgagatcgcgccattgcactccagcctaggcaacaagggcgaaactccgtctc

SEQ ID NO: 338165 - DNA, 522 bp, Homo sapiens
catccatttcgccatcctctgtaatggctccctgacttttcactgagtaaccattacccacgtcctactggatatgcttccatgagactgttagggcactcagctgtccacaggccaaggggagtcatgggaggccacaagactcaagctgcaccagtcagaagctctccctggaatttgaatcatgagcttatgtgacaggaggcccaaatctgattgcagctgatttatgttgtacccagggccctgaggaagctgccattccttcctgctacttcaatccctgctactgccctggttctagtcttttctgaaggctgcttcttcagtctctccctctgttgtgagtgccatcttaatctccttctaataaatatctttcttgcttaagttagcaagagtcggtctctgttgctgcagccaaagaaccctaactcatacttgtcctttcaagaatttgggatgagatgaggaggacaatgaaggacaagcacgaggggagcatagcctggaggaaggtag

SEQ ID NO: 338166 - DNA, 200 bp, Homo sapiens
caagctaggactacagccttgtgccatggtgcctagctttgaattctttttttaaaaattgttttattaatagcagttttttagttgattttcttgggccttgtaaatattgatcctatcattaacaaatagtaaaacttttaacttctcttttctaatttttacacatctaacttataacttttttttttttttttttt

SEQ ID NO: 338167 - DNA, 455 bp, Homo sapiens
aatcagatatgggagtgagtggagcaagacggtggaaaagaagcctacaaacattggttcggctgctagaacaccaaattttaactatctgcacacagaaaagcaccgtcacaagaaccaaaaatcaggtgagcaatcacagtggctggttttgacttcatatctttgaaagaggcattgaggagggcagaaaagatggtcttgcatcgccaatgccacccctccctcaccccctagcagcagccagccatgtggtgtggagacagaacctatgcacttgggaaagggagggtacagtggctgggggcctttacactgaactcagtgctgccctgtcacagtggagaataaagctgggctgggctcagccagcgccagcacatggagggagcatttggacctgccccagctagacaggaagcatccatcccagtggtcagaacttgagtttccct

SEQ ID NO: 338168 - DNA, 222 bp, Homo sapiens
tagcgccaccatcatctctctttcctcctcgtccatcccacctcccctcctgactgctgctcataggctaggaagagtggaatttggagctcagttgcctcctaatccagccaccacctccactgccctctcgcacacacatgcagacttcagccttgcatatggacacaaatctgtgatccggtgggtccacgttctctctttgtttcaggcctcatccaa

SEQ ID NO: 338169 - DNA, 530 bp, Homo sapiens
aggggtatggcatccaaccctatcattcttttatgctccacaaaagaggtaaagtatcacgtgggtcaaaattccatcccagtcatccaggagtgggaacagaggggcagcctaaggaaaagatgaggactaggctggggcaaacccaagatagtggttctcaaactttagtgggcatcccaatctactggggagttttctcagaatcagatgtctgggtccctccctacacctgatatatcagaatgtcctggagcacatctatttcaacaaagctcaaactgctgacacaggtccaatagaaagtttagaaataatgagaaatctaccgcaactatcagcagttccaaaataaaagtcatccactgcaaaactaggtttagcaggtcagaaaggggcgaaaaaggatcaccagcctgcatgtctaacaggctgcgctaggctggagcctgtaggagaggtccattattatgaaacaaaaactgtgttctataaacaaaatttttgtgtgagaaatatttcaaacatct

SEQ ID NO: 338170 - DNA, 370 bp, Homo sapiens
gccccatggctgatttgctggaatctcattgtctggccccagtgaccatgggactggatcccagggcttcgcctaaagtctgaatttgggctgactgggctcttggcacagatggtcctccccagcaggtcacccacttgggcagacacacacacactcactcacacacacatacatacactcacagtcacacacacacactcagagatatcctcacacactcacatacacatactacacacactcacagacagcctcacacatacacactgtacacatacactcatatacacacagtctacacacacacacactacacactcacacacactacacattcacactcacgcacacactcatgcactctcac

SEQ ID NO: 338171 - DNA, 323 bp, Homo sapiens
aaatgtgtcctagagttaaagcccaatgctatggacacaccaatgaaatacccaatggtagacttgtgggaagacattcttacctactatcattggaccctatatacaatgtacaagtaacactagcatttggtgtaaataatgatcttttatattctacctcctaaaaactgactgatggacaagtaaagtatgttatatttatattatgaaatactgaccagcaattaaagtggaaaaatgctacatgtatcaacataaaaaatggaaaatgttaagttcaaaaagcaaattgcagaaatatcctacatgattatatatac

SEQ ID NO: 338172 - DNA, 241 bp, Homo sapiens
attttagacttgtaaacacaaatgataaatcaaacaggctataatgggatgggaattaccattcatacagtgggatggggattaattttactagtagtacttgaattgttcatagaaaatttagaaacacaagaaaaaatgtaagtcactataaagccaccagtcaaaaataactaccatcaatattttgggaccttcccttctagtaccttttcttatacgtacactttttttttttttt

SEQ ID NO: 338173 - DNA, 304 bp, Homo sapiens
atttcaagtttcttgctatactgatgcctatgtttcagtttcccaatatagtgatatttgtacctgactagaataaaatttcaattatttatcaattagagaaacaactacagcagtttcaccttgaattaagacaaattatcacataaaatattaaatagtaagcaaaacaataccagcaaaaacatgtcaaacaattaataaaggatagtgcttttttcttaagtaatcagataactacccaattaatcaaataactacccaatgacaaatattttattttactaattaagaaaaggataat

SEQ ID NO: 338174 - DNA, 198 bp, Homo sapiens
tgcactccagcctgggtgaccaaatgagaccctgtctcaagaaaacccctcaaaaacaaagattctattttgatttatttgcagtgtttgagtgtattgctttatatagttttcttagatgttgttgtaggtattacaatatacgtatataacctatcccagtctaatacataacctatcccagtgttttaccaggtt

SEQ ID NO: 338175 - DNA, 309 bp, Homo sapiens
tcatcctgaccctctccttcataaattattcagcttcctacactattaaagtttaccacaaccaccaccccatcatactctttcacccacagcaccaatcctacctccatcgctaaccccactaaaacactcaccaagacctcaacccctgacccccatgcctcaggatactcctcaatagtttatgcattttcctactggggtgcttatgtttctctagttaatttgcgttcttcattgtatttactcaaggtatttttcccccagcgcttgcccttgaaatctacacatgacttttttttttttttt

SEQ ID NO: 338176 - DNA, 220 bp, Homo sapiens
cctggatgggatcctgggacagaaaaaggacttggggaaaaactaaggaaatctaaataaagcatggactttcattagtaataagaatcaaggttgattaattagttgtgaggaatgtaatgtaagatggtaatcatagggaaatctgaaatggaatttatggaaattctgtactacctttgcagttgttctgtaaatctaaaacggttctaaaaaatac

SEQ ID NO: 338177 - DNA, 105 bp, Homo sapiens
caggtggggggtcgaagtaagttcaaatccaaaatagagaccactgggctagtagacacttcacattagaagcatggctaggtgtctactccctgagaaccaaaa

SEQ ID NO: 338178 - DNA, 415 bp, Homo sapiens
tacccctacagttgcctattctaaatatgtgtaagaatatcttctcatttccttgacactgattttcaagattgtatccttcacacaaaattatcttcttccacatgactatgtctatttcatctaactgatgtcattgtcagcatcatttagaatgttaagatttttaaatccaattaatgaattttccaggtgtaacataaaatcacaattttctaaataaaatccaacctgtatttgctactgagtaaaagttttactccacatgtattgtcccaattaaagattacaatacatacttttttttcatttatttatattaaagtctcagaaaacagttgtgtgtgtccacgggcgtgggtatgtagagatggagtctctccatgttgaccaggctggtctcgaactcctgggc

SEQ ID NO: 338179 - DNA, 518 bp, Homo sapiens
aaatgcttcactggaaagtcttgaggaggcacctttgtgggactttccgtgtaggaattgctgggcagaggttcctagaacctgggaatttcccaagctactcaggcagcaacctggtaatctttaataacctcgagtgtgcccagagggggctgtgtgggggcaaaggctggggatgagggtggatagacatagcgaggtaaaaaggctttgcctctcggctgagcctccagtgcttgtttacatgtttgtctcttaactacactgtgaattccttaaaagcagggtcagtgtcttactcttcctggtatccacatctgtgaggtatgctcacagttgtgagcacaggctaggggctcaatcaattatctccttgaatgaaagcaactcttcttccctcttctcttcagagtcacttttatttttggccagtagtaagttgagaagactaactgggaaaagaagggtcaaatcaaggcccttcttgatagtgaagcctcagactctctagtttctgt

SEQ ID NO: 338180 - DNA, 208 bp, Homo sapiens
agagcaaggccaaagaaaactgtagaggaagagggtttgtagcttgttggctcttccaccatcctgctgcttgtgagtgtctctgaacctactatgtgtttggcaatgtggaaggtggtagagacaaaacagagaacaaaatttagtccctctctgggccagatgcagtagctcacgcctgtaataccagcactctgggaggctaagt

SEQ ID NO: 338181 - DNA, 263 bp, Homo sapiens
aggcatgagccaccgctcttgacctcaaatttatatttaattgcacttcatttttcttcgtgattatctgagatactttctttccagatatttccaatgttcatcattttttaagggatgtttcttgttaacagcctgtagatggagtctcatttactgtgttaatacatgcctggctttattgcttccatcttatataatagcagataaaaatgaaatattttctgtttttctttttctccttctcttttgttgaattacat

SEQ ID NO: 338182 - DNA, 128 bp, Homo sapiens
ggaaactcattttgacatgccaactcaaaccacagaagccagagtcagttcagctggtttcagtagtaactcaggaccttgacaattctgttaagccatgtcctttaaaagccagctcttattaagta

SEQ ID NO: 338183 - DNA, 230 bp, Homo sapiens
ttctctgttatgaaactgactgtatctctaaacttaaaaaaaaaaagctttctttttgttattgacagcacaaagaagctatttataaattatgaagtttcgctcccctgctataattttccaatattcagaatgtcagctcaatttgctctgacattcaaagatgagagcatggcaccgcaaagagggcatgtcactgcaaaagaatgcacctccaaacggctttgcaa

SEQ ID NO: 338184 - DNA, 325 bp, Homo sapiens
gagctctagaccagcctgggcaacattgcaagaccccatctcaatatttttttaattttgaaattttaaatgcagcagattgccaggaaatagctgtcaaatgatacgagtgtgatttggaagataatctagaaagacttcttggcaagtatcttaagtttttgttgactttcaagaaatgaaggctggaaatgaaggctgatgcattaacaggtgtagttaatgcatgaaggatgacatgagactccagtcagccaaccagagctcaaaaaatctgcagtgccaggtcctcaaaagatgggcacacattatggagggggatcct

SEQ ID NO: 338185 - DNA, 219 bp, Homo sapiens
gatgggacgggacgggatggggcaggacagagcagggcagcttctgcaggaaggagcctctgcactggcagtggcactgacggcttcaaaggagctgcgaagacacaaactacagaaagaatagaactcaattcttccctccttttacctcaatcaggtggccttttggtcttactgtatttttggcaacctgtatttagcacctacagaaaaagcagg

SEQ ID NO: 338186 - DNA, 362 bp, Homo sapiens
taataatgcaatgtggcaaggaagatgttgctggcttttatttaacagcactcaatcaatcaggtgatgccaggcctgcttctccatagtgcagtgtctttgatatttactgcaatgatgttggctataattctgttacatgataaaagagatttcaagagttttaaaaaccccatcaaaaaaagagttcattctggaaccacagatgtctggtttctttgctgagattcatatagagtaagatcattgaatttagcaatggatttcagacatcaaattctacctttaaaaacatcatttaaaaactaaaattagaatcatcaaccgcttctcaactaccatatgtcagtgattatggggat

SEQ ID NO: 338187 - DNA, 443 bp, Homo sapiens
ttataagcaattctgtgtgtaacataatacaattaaaatacatatttagtcaccaagtggaatgtcaaattgtgctgtcgtgagataccagggattctcctttctttctttttcatagtagatagggccactccactacccattattcttttttttcagctgacccaaaacaggatctgctttggcagaatgagtggtgagggataaggtacaagcagttctaatgtctgcccatcttagccattcctcatctactgcttcctggtctcatcaggttgaactctaaaagaagtgtccctagttcagcatagccccaactagacttctatgactttttgcctaagacatggtctatacctctaactttgagggtactcttagtaaagttaccttaaactatcaatcttgaattgtctttccaaggactgaccggaatatctgca

SEQ ID NO: 338188 - DNA, 279 bp, Homo sapiens
attagagggaagacaacagaagcaacacaataagtgctcaagggagatattacaaggtcctaaagaaaagcagtgacagtaggaaaaaagggagagaaagagagtccacagctactgagaaggtagactcaagaggacttggttatctatgagaattagggatgcgagaaaggcaaagacatcacagatgatgttttccatgatctctgtcctaaataacagggcagatcttttttttcttttctttctttctttttctttttttttttttttttttgc

SEQ ID NO: 338189 - DNA, 387 bp, Homo sapiens
gcaggagaattgtttgaacctgggaggtggaggtgacagtgagccgagattgcgccattgcattccagcctgggcaacaagagcgaaaaaaaactccctctcaaaaaaaaaaaaaaaaatctttaattttaatcaaagccaaatcaaagctatttatgatgttaataatttattcctgcgggctattgatgcactggagtggttccaaggaagaagaactagaactcttagagaagaagctagcattgattagacagggaaagagaaaacctaaacagagcagcatgatagctgactttagatacctgaacttttacatggaaaaaagagttctttatcctgtgttaagcccaaaatatagaactagggttcatgagcgaataatag

SEQ ID NO: 338190 - DNA, 929 bp, Homo sapiens
ctgacctcgtgatccacccgcctctgcctcccaaagtgctgggattacaggcgtgagccaccgcccctggccattattttgagttttttttagaaagcttttacaagattacaagaaatgactctcttagggaagaaaaataaccacccagtttcccttcctagtcttagttcaattcatagagtgttgtgtttatccccaaagggtcttgtagtcttcactgcaaacatttgattctgatctactcacatacaaggaaatgtagattgccaagaccaaaactagaggggtgggcttcccatcagggttttcctgtgtggagatgacaggggaaacagggaggaaatcctaattatggcttgtcctcttccctgaattgctgtctacgacagtgtagttccaatgtaaacaaggtgggttggggatggtttgtatagggcaggaggcccacccagaagtcctacccagggaagagagggcccagaatctagttgcagcatttgcccagtaaccctaccccggcctttctttgtgtgttaggaagctggaaatgcaggctggtctccctttcttgcctttgtcactaaccccgagctgtcagccatttggaatcagaactgctttccagtgttctaagtccttatttgattacaaatatttggtgaatcaaagtaaggcactttggtcctaatttttgacctttggtcctaatttttgtttgtaagatgtggagaataaccctgaccttaccaggggtcctgggaatgtgaatccattcgtcaagtggttccacatctagaagaattttgcctatgccgtgtcaggcatcattcaacacaaggccaactatctgctgccagtctggcataagatcagattgaaactgctaagtaatggtacatccaaataaacaaagttcttccaagaga

SEQ ID NO: 338191 - DNA, 449 bp, Homo sapiens
catgagccaccaagcccagctcatcaatggtatcatcttatgtataaactgcatgagccctgcccagcacatgtggtaagcgtgtagcctgggggacccctttggggtgtctgttgatttcctcaggcctcctcaatttcatgatttctccgcgaatcaaggcagcacagaaacaatgatagtgaaaatttgcttcattcctttttaaatctcttaacagcatgtcaggtgttttgagcgtgttcccacaacaataaatactctttgaaaacataatttttaatgactacataatgttctgccaaatggagataccataatttatttagccgtttccctattattagacacttaagttgtttccactttttttctctctctgtcttttgtttgtttgtttgccattatataacactgtcttaaagatctgtgtatgtaaatctgtttat

SEQ ID NO: 338192 - DNA, 228 bp, Homo sapiens
aattgacaaaatttgaatatgatctatagatgagataatagtactacatcagaggtaatttcctggccgggcatggtggctcacacctgtaatcccagctactcaggaggcggaggcaggagaattgcttgaacccaggaggcggaggttgcagtgagtcgagatggcatcattgcactccagcctgggcaacaagagaaaaactccgtctcaaaaaaaacaaacaaa

SEQ ID NO: 338193 - DNA, 156 bp, Homo sapiens
atggcttcagtaccagatttggctgaaggcagcctaatcctctttacctttagttgatagcaaaaaagcaaacaacaagggaatgtgtggagttgaaatagcttgtttactcttgtggtcctaagaccaaactgatcaacctcaggtgcataattg

SEQ ID NO: 338194 - DNA, 322 bp, Homo sapiens
tgctgagggacagagcggggagatgaggattccaagaatgaatagagtgagttctcttccttttaaagttgcaaatgaatgattactcaatgtggcagctacgagctgcagtgaacagtgcaaaatagcaagtttctgggtcttggggaatcgaggaggcattttttgagtgtggttttgcagaataagtcagcatttacccacagagacaagcaagaaagatgtcctaaaaagcaaagcagcaactgcaggggccacctagggacaaaaccccaagtcctagtctgttgctgtcaccaaatgtcacgttgcctctttgtgc

SEQ ID NO: 338195 - DNA, 675 bp, Homo sapiens
tatgcagaactgcctaaaagaaagcaatatatttggttttagaataaacatcagagccaggagcggtggctcatgcctgtaatcccagcactttgggaggccgaggcgggtggattttatcagctaattttatcagtaatgggtcatgggaacaaaaatgatccttgtttgtgtgtgtgcataaaaatagtggtaaatgcgttattcaacatagcccttaaaaacaccactttcaaatgggccagaaaaaaatgtacataaacagaaaaaagataaataaatgattaacaactagagaatctgggtgaaggtatatgagagtctatctaattcttacatttctgataatttttaaaaagcagtggagactagaaaattaccttttacattaacatagttataaatctaatgctagttatcagtgaaatatgacctaattgatgaggagggtattaagaacaattttcaagtattaaggaacatatcttaattatagctccagatttaatttactgataattgttaccctttacttcaacaggtgtgcttcattcattcactcattcaacaaatagttattgaacgtggtcactatgtttcaggaaccttctgagttttaggagcatggcagtatacaaatacagatgaaatccctgaattccacgtctttgtatg

SEQ ID NO: 338196 - DNA, 517 bp, Homo sapiens
gctggtctcgaactgctgacctcaagtgatctgtctgccttagcctcccaaagtgctgggattacaggtgtgagccaccatgcccagccagtgttagtaaatgttttgtgtgtacttaagaagaatgtgttgagtggagttttctaaaaatgttaactaggtcacattggttgatagtgttcatttaagacttctgtgtcccttttgattttctgtttgtttcaataatttctgaaagagaagtgttcaatattcaacttcaattgtggatttatttttccttttactggttcatgtgtttggaggctctgttactaggtgcatgcgtaataagggtttttatgttttcttgatgaattaggtctttgtcactattaaattttgtgaaatagtttgtgaaatagtttgcatagtttctgacaaaaagtctgctgttcttaccttttgttcccagtatgtaagttttctattttctttggctactcttaagactttattactaggttttagtcatttg

SEQ ID NO: 338197 - DNA, 451 bp, Homo sapiens
ataaaaccatgccccttacatatgaaatccaactcatgtgttttgtatttaaaatatttctcaaagtttaagtattgttgtttcataattattcaagacaattatgcattgcaatacacgttttaaaaagaaaaagcccaattcatataatttctcaaatgcttcagaaaataagcctaactacgtattttttggttttcatttaaagttcctggcaataaatattagccacaactaatgagggggacaatagagtttaattaagtctttacataatataatgtcttacaaagtagtttccaaagtaacatttaaagacattaaaaagtcgcactaagataaaaaattatatgcctttgctaaacatagcattttgaaacatttcctaccatatagtaatctctgattatttggaaagaaatctcctattgatattgtgccaagaaaaatt

SEQ ID NO: 338198 - DNA, 459 bp, Homo sapiens
ttgtttcatagcagatatgtgactaagacagttgaaggagccactctagattggttggtcaagaaaagtctctgaggagttgacatttaaactgagacttcagtgacaaggaggcagtcctgggacgatgtgagtgaaattcattcttgaacgttgcagactctgtggtagaaaaagcttggttaagatgtaataaatggatggggctgggaaagaggatagaagatcctgtaagagggagataggggacagatcatgtagagcaggagtcggcaaactctttctataaagggccagatagtaaatatttagactttgcaagccatgtatggtctctgtcataactattcagccctttggctgggtgcgaatcatgcctgtaattccagcactttgggaggcccaagagagcagatcacttgaggtcagaagttcgagaccagcctggccaacatggca

SEQ ID NO: 338199 - DNA, 435 bp, Homo sapiens
tatagaaaaacatgtttagaaatttgccgtaattggctaaattactgttgctattcaaatgtttcatccctggtaatagaatctcacccaagaaacttgcctttcttccctggggtctgaaatgagaaatacagaaatatctattttaagaagttctcatgtaagaatacctgaattcataatgaagagtgtttgcataccattaaaagcctaccacgtgccaaactctctgacatatattacaacagtcctgcaagatagatattattactcctgttttaaagatgatgaaacagaagctcataaagtttaacaggcttgcccaagatcttatagctagtacctggcagaaccagaacccagagcaaagagacacaacggtagagagtagaaagtgtgtggcacaaagtgtgtgggttcacagcccgactgaac

SEQ ID NO: 338200 - DNA, 874 bp, Homo sapiens
cggggcaggaggcggcgggtcttcgggcctaggcgagcgccaggtctcccgacggaaattaccgaaggctggcagaggcgccgaagccgggagtggtggagccggaggggatagtgggggtggggaattccggccgaaggagcgaatccgggtcggactgcgtgattcggcccggtgggggcgggcagggtgcgcgcctgccgcgcgcccaggttaggtgtgtccgctcttttcacactcgcggccggcgcgcgcgggcacgcggcagaggagggggcgcggcgcggaagggccggcggaggcggcgggagcgccggcgcttggtgtgcgcgccttgggtggtgtcccccgcctgcggaatgggtaatgaggcttttctccgcagcaacagcatcacgagtttcagttcccaggagcccgccgccgcggctgctgccgctgccacgacatgagtcaggctttcttccctggcgcgtggcggaaacctcctccccctcgccgcacctgggctcgcccccggcccttgcctcctcgggggatgccctagggccgggagctgtggggtctatggaaggccggtggctcccggtgataggtgttgtcttttgtgcagtgcagttgctgccatgcggtcccctcgcccttccacgggcaggggcgaggcggccgggcagatgttgcagctgtttccagttaactgcctgagctcctctgggctaggctcttctctaacgaggagtggttgcaatccatccttaactggaggacagaagcaggccggccctgtaatcgactgacctcaacaggtgtctccaagcagcgacgcctttttcgttcatcgtcctggctatatcccccattggtttgactcagg

SEQ ID NO: 338201 - DNA, 742 bp, Homo sapiens
  misc_feature (387)..(387): n is a, c, g, or t
  misc_feature (485)..(485): n is a, c, g, or t
  misc_feature (534)..(534): n is a, c, g, or t
  misc_feature (539)..(539): n is a, c, g, or t
  misc_feature (653)..(653): n is a, c, g, or t
  misc_feature (698)..(698): n is a, c, g, or t
  misc_feature (731)..(731): n is a, c, g, or t
  misc_feature (733)..(733): n is a, c, g, or t
tgctgggtgttaatcggccgagggctgccatgagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcaccctgtgcttgcatgtgagaatggatgtgacacttgcatgtgcatgctcacattgcatctgccttgtgctgtgtctttacattctgacctgatgtagctgctactgcttggaaaactgtgatgaaaactgcaggtgcttgcttgcctttctgctnatcaccagattgtcttgaacgaagtgttgtgtacatgcactgctgaagtgtagtacctgtgacattcaaatgtgtcactggccataactgcatgtgcnctagatgccatctgtgtgtgactaagcccactgactaaatgaaacctcntatgnaacgtacaatgattaatgcccaaaatgtgtacgtctagctgacacactgaccttagacatgtctagtgtatgtcattgcatgaccaacactgtagcctgtagacgtgcacgctntcctacatgtggatcgctttgtaatactgtctggctggcatattnacgctatatcgacacgcgacgtgcgtagaaccntngactaatga

SEQ ID NO: 338202 - DNA, 508 bp, Homo sapiens
agggatgtggccttcggtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggaaggtgtcatctccagcttccgcttgcccctggcttctggcatccaacacatgggggataatgatgctaccagtcgtttcctgactcgggacgaacaagtacacgggaagctctttgagaacagggattggatctagtctactcctgtattctcagcacccagcacaaagtaggtgcttaataaatgtttgctgttcggaaaaaaaaa

SEQ ID NO: 338203 - DNA, 3212 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338204 - DNA, 3951 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctaaaaaaaaaaaaaaaaaaaaaaaaaaaaaaaaaaaaaaaaaaaaaaaaaaaaaaaaaaaaaaaaaaaaaaaaaaaaagaagagagagagagcgcgggagagagaaagaaaaataacgcagagaagggagagacaacaagatcctcccgaccacagcacgggtcgtcacggcaagaggggcggcacccacaacgggcggcgtactctatataacacgaccagagacgcgaggcgggaggcagagaaacaaacaaccaagcgagagaggggggacacagagaagacaaggagggaacaaaaaagaagagagaagcgaacacacaaaccagggcgagagagaaaacacaaaaaggaggaaagaaaaacaaaataaagcggagaaaagagaaagagagcgccagacgaggcaagcacaaaaaaaaaaaagagaagagagaggagatcaacggagggagaaaaaaccccacgacaggacaacacaaggcaaggaagggcggcgagaagaagaacacgagaaaacgacgaacggacagaaacaaagcgacagaaacaacaaaaatatgacaacgagcgcgaggaagacacgcgcacgaagcaaacaaaaggaaaccgaagaagaaaacaacaacccaccagagacgaacaacgccagagaaaaacagacacaacaaaggaagagagcaaaaagaaacagcagaagcacaaacaacgagcaaagagcaaaaacaaagaagcaaacga

SEQ ID NO: 338205 - DNA, 2061 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338206 - DNA, 3645 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatggtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccctggccctgacccttggacctggttccatgtccccaccaggaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338207 - DNA, 4278 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccaggtgagttgtctctgctttgtctccaaatcctgcaggcgggtccctggtcatcgaggggtaggacgaggtggccttgcaggggggagagcctgccttctcttccgcagcccgggggagtgggagcctcctccccacagcctgagtcctagacagcccacctctgcatcctgcccctcttgtctgagccccagactggagggcaggggcagggctggagtgtgagggatgggggagatgctacctcccttctaggggccaggggagggagggtctgggtccaggccctgctgctcacacctctctcctctgttttctctcttagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338208 - DNA, 3107 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338209 - DNA, 3063 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggagggagggtctgggtccaggccctgctgctcacacctctctcctctgttttctctcttagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338210 - DNA, 3761 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccaggtgagttgtctctgctttgtctccaaatcctgcaggcgggtccctggtcatcgaggggtaggacgaggtggccttgcaggggggagagcctgccttctcttccgcagcccgggggagtgggagcctcctccccacagcctgagtcctagacagcccacctctgcatcctgcccctcttgtctgagccccagactggagggcaggggcagggctggagtgtgagggatgggggagatgctacctcccttctaggggccaggggagggagggtctgggtccaggccctgctgctcacacctctctcctctgttttctctcttagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaactcatgccaacaccaaaaagcaaactccagggggttccccgtacccaatagggcccatggtgagtcggcccacaattaacttgcccttctattacaaccgtctagtcttgcgaaaacccctgcggttacccaccctaaatggccttgcagaacttcccccttttgcccgattgccgtaacatccaaacaggcccctaccgatctgcccttccaacaaatgggcaacccttaatgggcgaatggcaaattgaaagcgggaaaattttggta

SEQ ID NO: 338211 - DNA, 3287 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338212 - DNA, 2482 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaacaataaaggattttatcaaatcaattaaatcgaaatttctactc

SEQ ID NO: 338213 - DNA, 2785 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338214 - DNA, 3174 bp, Homo sapiens
tgtcatgttagttaagcaggcaagaaatcctagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338215 - DNA, 2494 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatggtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccctggccctgacccttggacctggttccatgtccccaccaggaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338216 - DNA, 1819 bp, Homo sapiens
  misc_feature (6)..(6): n is a, c, g, or t
  misc_feature (1768)..(1768): n is a, c, g, or t
  misc_feature (1807)..(1807): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgattctgggcttgcaaggaagctggggggccaacccacaanccccccctaacggacccttggtggtgggaaagggcacangaacaaccttgg

SEQ ID NO: 338217 - DNA, 2060 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338218 - DNA, 1739 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338219 - DNA, 1498 bp, Homo sapiens
  misc_feature (6)..(6): n is a, c, g, or t
  misc_feature (1392)..(1392): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcgaagctctggagggcgaaggnggaaaggtacgctgtcccaaggcttaccgggcacggggcgcgttccctcctctcccgcacgggggcccgtcccaccgcactgggccgcgaccggtttcccgccgca

SEQ ID NO: 338220 - DNA, 2620 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338221 - DNA, 1225 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338222 - DNA, 1048 bp, Homo sapiens
  misc_feature (6)..(6): n is a, c, g, or t
  misc_feature (920)..(920): n is a, c, g, or t
  misc_feature (924)..(924): n is a, c, g, or t
  misc_feature (927)..(927): n is a, c, g, or t
  misc_feature (930)..(930): n is a, c, g, or t
  misc_feature (941)..(941): n is a, c, g, or t
  misc_feature (944)..(944): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgcgtctgaagaccgactggtggngatngcnacnggacaccgganttnaaaccggtggggattccctgggactgctgccccctgggaccgtgggccttaaagggcggaaactttttgccccggaatgccggtttttgggacccccttgggcc

SEQ ID NO: 338223 - DNA, 897 bp, Homo sapiens
  misc_feature (6)..(6): n is a, c, g, or t
  misc_feature (841)..(841): n is a, c, g, or t
  misc_feature (843)..(843): n is a, c, g, or t
  misc_feature (845)..(845): n is a, c, g, or t
  misc_feature (851)..(851): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagacctgcangngnacggantccgcacacactttcacggagagcacggggacaagcccataacccg

SEQ ID NO: 338224 - DNA, 1113 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagtccaatgaggaccagtccagcgcagccgtggccgtgcttcctctcactcatcccagacacagggtgggggcagcgtcaccaaaaagcgcaaactggagtccactgagagccgcagcagcttctcacagcacgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338225 - DNA, 1551 bp, Homo sapiens
ctagaagccaagggaaaggggtgcttttatagaggctagcttctgcttttctgccctggctgctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctaaaaaaaagaaaagcaaaaaaaaaaaagaaaaaaaaaaaaaaagccaatcaacacagaatagaaagagagagatggcatgcaacagacaggagaaacaaatagagacaagagaaggacaacagagggagagcacgagaagaacaaataagcaccgacaatgtccacccagagcgagagaccaacgtgtcatgagtgacaatcgagaagcaaaaagtcaagcgaagcgcggaggcaggatggaggtaggagaggcggcacagccgtcccagagcggggcgagcagtggggcgagcaggcaagcgcgaggcaaacagcgcagtcaaggacagcggaaggaacggagcaaggagcacgaagaagtcagagccgaggggaaggaacggtgacgggagaacgaaggagaagcgagcgaaggaagaacgaaaggggaggcgaggagagagctacgcctgtccccaagcctactctgcaagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338226 - DNA, 1028 bp, Homo sapiens
ccagccccggggtgagtccattctcccaggtaccagctgcgcttgcttttctgtattttatttagacaagaggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338227 - DNA, 135 bp, Homo sapiens
cctagaagcggctccagcctcagcgccctcactagggcccaggtatgacttcgctgctcagccagggctccatgctcggcttgcttcctcaggtgtcatctccagcttccgcttgcccctggcttctggcatcca

SEQ ID NO: 338228 - DNA, 299 bp, Homo sapiens
tttcaaggaccttggggaggtgggagcccagccccagaggcaagcagatgcaaaccaacctaatgcaaggatgccctctcctggtaattgcaggcatagcagcgccagcccccatggctgacctcctgggagcctggcactgtctaggcacacagactccttctcttaaatctactctcccctctcttctttagcaataccaagaaggagggtgacctgatagctgctcaggctcggctgaaggacctggaggctctgctgaactccaaggaggccgcactgagcactgctctcagtga

SEQ ID NO: 338229 - DNA, 614 bp, Homo sapiens
gggagggtgcggggagaaggggtagtatgcggaaacagagcgggtatgaagctggctaacgccgcgcgccccctcccaggacccgctcctgccccgcgccggccggtcctgggggcccgcttttttatggaaatgaggagggggggccggggccgggggcggggagccgggagccgtccccgctcgctcactgcggctttctctctcgctcccctctccccgctccctgccgcgctcactctccgcttccccctcccgctctcccagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggaagtacacgggaagctctttgagaacagggattggatctagtctactcctgtattctcagcacccagcacaaagtaggtgcttaataaatgtttgctgttcggaaaaaaaaa

SEQ ID NO: 338230 - DNA, 598 bp, Homo sapiens
  misc_feature (17)..(17): n is a, c, g, or t
  misc_feature (20)..(20): n is a, c, g, or t
  misc_feature (23)..(23): n is a, c, g, or t
  misc_feature (27)..(27): n is a, c, g, or t
  misc_feature (30)..(31): n is a, c, g, or t
  misc_feature (36)..(41): n is a, c, g, or t
gcctcgtgccgaatctngcncgngccnaannggcannnnnnagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338231 - DNA, 3782 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggctgctgtggtgtctttgttggtggacgtcgctgtgtgtactgaggtgcagactcgtgggcatgcgcgcgcgtacacacacacacacacacacacacacacacacacacacacagcgccgcacggtcactgcatcctcctgctcattgctgcccagccctgccctgctccaggggaaacaattagagatcagagcactttgggtgcacatctgggcactcggtggtggctgagggggaaggctttgatataaccatcaccacccactgtacggctctctcccagtggaagtccttcagagaagcagcacctgaaggagggcatttgctaactaacttccctcgtccaccagcacttactgagtgctttctctgtgctgggccctgagcgaagcatgaatataagacatatgatatagacccagtctgagggtggtgacatatcaggacgtaaggacaaggacacccggtgaggagggaacagaagctgcaggagagggcagaggaaaggagcagttaatgtccctttgtgccatgttgtgctcaggttgggggattgggaaatg

SEQ ID NO: 338232 - DNA, 3956 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338233 - DNA, 4389 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatggtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccctggccctgacccttggacctggttccatgtccccaccaggaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338234 - DNA, 3133 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338235 - DNA, 3100 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgccgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338236 - DNA, 3226 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaacaataaaggattttatcaaatcaattaaatcgaaatttctactc

SEQ ID NO: 338237 - DNA, 2733 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttaacaaaaaaaaaaaaaagggggggccgcccttttttttttttgtgtagttacgtatgtgtttctgttttcgtgttgtcttgtgtagtcttattatagaaatgaggaggagatacaatacgcccaggggggttagtatagatgcacagaacaaatatactagcggtagaacagacaatgttttagcttactaaaaaaaggagagaggagccagccatatataaggcactgcgagccgcacttcctacacacacagccaaacaaatagcagagacacaaactataatacacaaagatagcgagagaggtgcgagacaacagaacacaacgatgcgccgcaggcggcagcacaaacagggcgaatcgcctgagggggagaaaatccaccgagcgcgagagacccaccaacaacacgagtatatatcgcacacttagttgtgttgttttaaaccataaagaaggtgtgtgtgcactccaacatcatccgagcaggaggcgccacaccacaacaccaccaagcaaaaaaaaaacaaaagaaaagacgaagaacaccagaacaaggagggggcggagcgcggcaaacaagaaaaatccccggcggggggggagcacctctgtgagtaggcgaaccgccgaggcatgcgatagagagacaagaaggagggggcgacaaaa

SEQ ID NO: 338238 - DNA, 2399 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtggtggtctttctgcttatttaataattgtccgttttttcatctaatgtctagttgtcaatttgggccttttttttatccactttggcttcggctttttgggtttaaatccctgtttttttgtgcgattaattctctttttt

SEQ ID NO: 338239 - DNA, 2596 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcagacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338240 - DNA, 1858 bp, Homo sapiens
  misc_feature (6)..(6): n is a, c, g, or t
  misc_feature (1794)..(1794): n is a, c, g, or t
  misc_feature (1805)..(1805): n is a, c, g, or t
  misc_feature (1813)..(1813): n is a, c, g, or t
  misc_feature (1815)..(1816): n is a, c, g, or t
  misc_feature (1821)..(1821): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccaaagcccctacgacctgtgtggagggcagaaactgggntggggacagcnggtaggtncnnatccnggggaaaaggctccggggggccactggttttgcccgc

SEQ ID NO: 338241 - DNA, 1842 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttta

SEQ ID NO: 338242 - DNA, 3120 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338243 - DNA, 3104 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcggggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338244 - DNA, 2833 bp, Homo sapiens
  misc_feature (6)..(6): n is a, c, g, or t
agactnacggctagtacgaggccgggtgttaatcggccgagggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338245 - DNA, 2702 bp, Homo sapiens
ctagaagccaagggaaaggggtgcttttatagaggctagcttctgcttttctgccctggctgctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctaaaaaaaagaaaagcaaaaaaaaaaaagaaaaaaaaaaaaaaagccaatcaacacagaatagaaagagagagatggcatgcaacagacaggagaaacaaatagagacaagagaaggacaacagagggagagcacgagaagaacaaataagcaccgacaatgtccacccagagcgagagaccaacgtgtcatgagtgacaatcgagaagcaaaaagtcaagcgaagcgcggaggcaggatggaggtaggagaggcggcacagccgtcccagagcggggcgagcagtggggcgagcaggcaagcgcgaggcaaacagcgcagtcaaggacagcggaaggaacggagcaaggagcacgaagaagtcagagccgaggggaaggaacggtgacgggagaacgaaggagaagcgagcgaaggaagaacgaaaggggaggcgaggagagagctacgcctgtccccaagcctactctgcaagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338246 - DNA, 1586 bp, Homo sapiens
  misc_feature (6)..(6): n is a, c, g, or t
agactnacggctagtacgaggccgggtgttaatcggccgaatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccagggccagcctccgagagggagagagagagagagaggacagcttgagccgggcccctgggcttggccttgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 338247 - DNA, 1189 bp, Homo sapiens
ctagaagccaagggaaaggggtgcttttatagaggctagcttctgcttttctgccctggctgctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctaaaaaaaaaaaaaaaaaaaaaaaaaaaaaaaaaaaaaaaaaaaaaaaaaaaaaaaaaaaaaaaaaaaaaaaaaaaaaaaaaagaagagagagagagcgcgggagagagaaagaaaaataacgcagagaagggagagacaacaagatcctcccgaccacagcacgggtcgtcacggcaagaggggcggcacccacaacgggcggcgtactctatataacacgaccagagacgcgaggcgggaggcagagaaacaaacaaccaagcgagagaggggggacacagagaagacaaggagggaacaaaaaagaagagagaagcgaacacacaaaccagggcgagagagaaaacacaaaaaggaggaaagaaaaacaaaataaagcggagaaaagagaaagagagcgccagacgaggcaagcacaaaaaaaaaaaagagaagagagaggagatcaacggagggagaaaaaaccccacgacaggacaacacaaggcaaggaagggcggcgagaagaagaacacgagaaaacgacgaacggacagaaacaaagcgacagaaacaacaaaaatatgacaacgagcgcgaggaagacacgcgcacgaagcaaacaaaaggaaaccgaagaagaaaacaacaacccaccagagacgaacaacgccagagaaaaacagacacaacaaaggaagagagcaaaaagaaacagcagaagcacaaacaacgagcaaagagcaaaaacaaagaagcaaacga

SEQ ID NO: 338248 - DNA, 741 bp, Homo sapiens
tgctgacgggtggagcgacacggaggagcctcagaaacacccaccatgctgctgcccggaagaggcaggcacggaaggccacgcgctctatgacctcatccatgggaaacgcacagaggcgaggcctgccagggctgggaggagggggcacaggagcgccggctgtggggatggtgtttctcccgccgggggtggctggctcaccctggcactgcaccgcagtgggggtggaccggatgccgctgaactgcctggactttcaagaggtaaattccgagctctgctctgaggcctgaccgtccctggccgccaagtgtctgctgactgagagctccagctccggagaggtgcccagtacctggtgagcagagggacctgaaggagcaggtgcctcttcctcagacatctgcagtcacttcacagtgaatgaggctccagccgggtgccctgagaagtggccaacaccctacccaagaggagaccgcacagccacggccaacgtggagctctaactcagggctccagcctccagcccagtccttttccttgagtagggacgacccccacagcggcctctctgcattgcttaggtggggagcacatgtggtgaagatgggcagcctgcaggtgcctgctacacgtgggggccacggccgacggaaagctcagtcatgagtgaaaacagaggaaatgtttctgaaaatataacaagtcagtgggaaatcaatttatcaaaagcaa

SEQ ID NO: 338249 - DNA, 284 bp, Homo sapiens
catgttggccaggctgatctccaactcatgacctcaagcaatccagccaccttggcttcccaaagtattgagattataggcgtgagccactgcgcccgacccaggtcaatgtttctttgtagatcctaaagtttcaatactaatcctcaaactaatattcatctgaggaaattttatcctctcacatagaaaatacttgtcaaaagggaaaagcccatttgcactttgccctataagtgctatgctacattttgactgagaatgtcacagtgatggcccaaaga

SEQ ID NO: 338250 - DNA, 388 bp, Homo sapiens
cagaaacagaaaaaacccggagggcagcagaggtgcttggttaaggtggagaagagagttctgccttggtcaacctagagagaggaaattgaggacttaaatcacgttttgggggtcatctccctccagggaagaagctttgtcttattcatttttcactcacagtgccctatcacaggagccaatgcctagcagagcttagtaagtatttgttgaactgaatttggattggcacccacatatcagaagaggaaagagagtcctggaaaccacattcagagtccgagtcccaaattggagagtagaaattctctgtgtcacccatagtgccacttggaggaaagggataaaaagactgggcttttaactgaggagaatgaggttgtgg

SEQ ID NO: 338251 - DNA, 134 bp, Homo sapiens
gagctcaggggcaggattctattttacagtaagcaagaatgaggttcactaaaaatatataactttctcgaaattaccgaaaagattactccataaaacaaagtaaatactatctttttttttttttttttttt

SEQ ID NO: 338252 - DNA, 708 bp, Homo sapiens
accatcccttatttgatttattgtagcaaaaggaaagcctgtgagaatgcaagggagcccctggctgctttgctggagtccctgggaggtgccccacacctctgccaccaaagtctgtgtgctcctgagcagctcgcggctttcacagtagggaaaccgcagtcctcgtcacctgcgcctttgtcctcccattcgtttaccctcccgttcacatccacacaggcttgtaccccacagaacttgacaggaggtcacatgtgtgaatggcctgtgtctgctttacagggttgagcaggctgagggtgtgtgcctctggggatgctgggctgacagcaaatcccaacagtatttcggctctggactgatttggcctttagtgcttccccaggcctctttcatcggcatgggaaaagcccttaggggtgggcggtgagggcacatttataactaacaaagaagaatgcagttgccccagcatcctactggtcaccttaagtggcagcagagccctccccagcggtgccccagtccctcagaagtgctcagtccggcccgagtgcccatctggtggctctgccgtgttcttctgggcggatctgtgtgcactacacagcgagtgagggcgtggctcacacaggtgtttgagggaaatgggtaatgcccatcccttgctgttttaagtgccaaatagcgtgttagcgcccctcc

SEQ ID NO: 338253 - DNA, 269 bp, Homo sapiens
atcacaaaaacacttgcacattaatgttcatagcatctttagtcatgatagcctcaaactgaagcatcaagagataaatggataaacaaactgtggtatatctatacagtggaatactgtgcagccattaaaaaataatttctgaacttctgaaacacaaaacatggattcatttcagaaacatactaagtgaaaagtcagacaatgaagagtgtatattggctggttccatttgtatgaagttctacaaccagcagaactgatctaca

SEQ ID NO: 338254 - DNA, 419 bp, Homo sapiens
tagctgctatcagaaaccaaaaaatgtgcttgtcgtcacagttgaggcagcttctctgtcagattggaactcaggttatgttggtgtctgactggttttgaggaataatgtgaggaaaccatgtattttcagttcagctcttttcctagcactgttatttcatggtgggtatttcctggctaggttgtagggatgggaagccgagacaaaggtgtagtctttgacaaagcaagtctttggagcaggggctgttaccgatgatttttttggtctctcatagctccccaccctcttttagctccccactcctctttttttctccttacctctcttatggcaaaagtttattcatttaaagtacaaaatgacttgagaccattaaaaattgaataagaagaaaggcatactgtaagcctcac

SEQ ID NO: 338255 - DNA, 110 bp, Homo sapiens
tacacagagtgacaaaaaaaaaggcctgaaattaaagagaaatatcttgagattctctttccccgcaatggagagagaatgtaggtagagctgaagaactaaagccacag

SEQ ID NO: 338256 - DNA, 337 bp, Homo sapiens
cgcctgtagtcccagctacttgggaggctgaggcaggagaatggcatgaactcgggaggcgcagcctgcagtgagccaagatcacaccacagggcacttccagcctgggcaacaaagcgagactccgtctcaacaacaacaacaacaaaaaaagacaagaaaggaaaagaaaaaagaccttattctaggaaacaagaaagactctatggtgctttaagttttattaagcaaacagatgaacatgcatttatgggaataagcacaattcaataggtaacttaaggaaaggtggtttttatttgttttatgtgtgcttttcatcaaaatgtcaaaactt

SEQ ID NO: 338257 - DNA, 279 bp, Homo sapiens
tgcactccagcctgggcgacagagtgagactctgtctcaaaaaaagcaaaaacaaaaaaacattgctattggttgggggtggcagagattatagagattcccccagggttttccctcttgttggtaacacctcaccatctctccagaagacaaatacacgcatctgtgatgtatatattcatatatgagaaacaggaatgctgcaatggagtttcgtattcagactagccctaactccatcttgattgagagccaagaaaacacctgctttactgaggc

SEQ ID NO: 338258 - DNA, 672 bp, Homo sapiens
ttcagatcattatacagagagggaaaatcactcaaaccttctacctctcaaattctacaactccctttcttccagctcccacacgatatacacagccttctctttaagaggttcatctggtaaccccaaatgactttttaacatttaaacatgaaaaacctcttacatgtatatatggctttaaaaggcagtgcagttttggtctccaatctgatttaatcttttatcagtgacccagtcaccaacaggaacaacaattctcacacgggtaaaatggacaatgcaagaggcctgtctccactgtgaataaatgtgcttccttcgccccctgcctctgctgacatatggaccagtgttttcagcccctgcttggcaccatacatgtcagtggtcagggaccaagaacaaatgggcctttatcccccaagagaagcagcacatgtgattggcaacaactattttttttcttactcagacatctcagacatctttttaacttagatgttacagtcatagaaatttagagctgcagggaactgaagagaagatttatgaaataaatgaagtatttaccaagattctagttcaactaagtattgaactatggattactacactgaagagtctttcagaagaagaaagcagatcaatatgagactatcataacaattt

SEQ ID NO: 338259 - DNA, 458 bp, Homo sapiens
ttagccattccctgtttaactgggtaatatgaactgtggctttcttgcaaataataatgttatgtatctacctaccctatttttgctatgtcattttagacctgagatcatggggaacatcaaataataataaaccaaattagtatttattgagcacttactacatgccaggccctatgtcccgtgctttatcatggattatgtcatcaaagcaaccctatgatagttacttactgttatctacacctcatagatgaggacactgaagctctaagtggtcatatactctaaagctggtattttaaccagaatctgtggtcctaaccaacctttaacccaatttataaatatgcttttggcatgctgcgtgcaaacccacacacatgcttatacacctgtaagtcgtgctgaggttttcctgcatagggtgtaccagagacacacttctcaaaagctcc

SEQ ID NO: 338260 - DNA, 274 bp, Homo sapiens
aaggagaaaaagaccgtttagatacggagtagcaccagagactggcctccacccgtccccaagctgaagcttgctgtgcggggttctggtttctcctgggggagggagagggcctgccggctgtgcctcctctctgcaccctccttcccctcccagatttctggtggtcaagggcacagttcatcctccggacaggaggggaaggagtttgggggtagggccccacctcgcaggcaccttaccaagataagcagaatccactcactggcactgc

SEQ ID NO: 338261 - DNA, 2892 bp, Homo sapiens
gcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagcttgaggaaaagatcctgg

SEQ ID NO: 338262 - DNA, 2427 bp, Homo sapiens
gcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagcttgaggaaaagatcctgg

SEQ ID NO: 338263 - DNA, 3169 bp, Homo sapiens
gcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaaggcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagcttgaggaaaagatcctgg

SEQ ID NO: 338264 - DNA, 2065 bp, Homo sapiens
gcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaaggcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgagggtgagtgcagggcaggcagggaccctgtgacagtctgtgcgttcagccaagcccctttctgggcaccgatggtgactttgacccagtactgaagctcagagtctgtcgaggaagacacatgtggtccctgctgctgcctgaggattctgggcccagctgcctacagctgagagcccagctctgccacctccttgatgtggaacttcccttattcataaaatggggggcagctgctcttaccatccctcctccagatggggaaactgagcccagggaagggtagccctggccctggctcaccagaatggtcaggctgtgggctcctgaccccgactctgtccttcagactcgggggagtcagaggccgacctggagtgcagcttcgcagccatccactccccagctccgcctcctgaccctgcccctcggtttgccacgtcgctgccccatttcccaggtaagcaggggccagacacgcaggggactcgctgctcgggcctggcttagggccagtcacaatgtctaagcacaggccctgcacttggagcccactgagcctggaagacggggatccctgcttctcagc

SEQ ID NO: 338265 - DNA, 433 bp, Homo sapiens
tctaaaaatgtctaacatctactgtggacaagactctgtgtcagtggctgtgaccagttccatttcctctgtcactgatgaaggtggagatcactggtcctgctttgaaagacttgagtgtggagccttgacttccatttctctctgaactcttattagcgatattaaacttgcctttcttctactggtctcttgttgttgttacttctggtctttcatggttttccctgctgggatggcccacagccagagatcatagctagagctccttcctatctggatttgtcactagtgtttctgacatgggatttccccaggcaggctttatttaattcacaaagggccagagcaggctgggtggcaagggataaagcactgggactactagagaaaagaaggatttagaggaataaagaactgagactctgcggga

SEQ ID NO: 338266 - DNA, 192 bp, Homo sapiens
cctctttccagcctctcttttaagtactcagtactttgtgaactgaactaattactgttctacagatacgtgcttccatttcctgttgttttaccttagtctgtggtgttctcccatctgaaatgacattacccccatctctgtatagtcaaacctccctatcctaaaagactaagactcaattcaaatgct

SEQ ID NO: 338267 - DNA, 236 bp, Homo sapiens
atgcctcagagcagcatttctcctactttaacatgcacacagatcacttggggagcatgttaaaaagtaaatcctgattccttggatttgagggtgggctggagactcttcatttctaataagctctcaaagtgaggccaataccgctggttccagaggcaaagccctagaatccagggtctagaactgtgtaggacctaaatctaaaatgtactggggaggggaataatggaaca

SEQ ID NO: 338268 - DNA, 153 bp, Homo sapiens
tcagggcagagcaggtagcaggtaatctgaatgagtcagggcggagcaggtgatcggaatgagtcagggtggagtaggaaatcgaaaagggttgctttacgaggaagttacttttaaaagtaaaaggcaaagaattgaacacactgacatatt

SEQ ID NO: 338269 - DNA, 387 bp, Homo sapiens
gatggaggccgtagtgctgggataagagctcatagtgtagatatttttggactgagtcttatcagaagacactttaggaatttcaggaatcagaagggtgtgattgggaaaacaggggcagagcttcccaatgccccagaaatcccaccaaatagaccacactgagtctccagtcagatggtgccaatctctctgctctaccccggcagtagtaggcctacgatattgctagatagcattcatgaagttccagctaggccaagtacttttgcaagttcatgagcaggcccctagggtagtctagcttgtagtctagatgagaaggctgttgctaatgcttgaatggacttttatttgattatttgatttaaatgtctcaaaaatgga

SEQ ID NO: 338270 - DNA, 239 bp, Homo sapiens
tagaaggattccggattctcttaccaggtgtcagaagaaaccccttgacattctctacaatggacaggttccaagatcaacaaatgaatcaaatcagtcctgaatggaatttcttgtcctaaagagaaatcagacaaggtctaaaagaaatcaggcaagcctaaatgcaaagcaggagacagagctggcagaaatgcaatacaatcacttcttcctttttttttttttttttttttttt

SEQ ID NO: 338271 - DNA, 527 bp, Homo sapiens
atcttctatatcgctcacgttgggagctgttgaccagagctgttcctattcggccatcttggctcctcccccctcatgtaaatattatcaaaacaagaggagaaggggtcaaaataatgttacacaagctacaagttaagttaaaaactgtcatactttataaagtgtatttaagtcaaaacttcaaaaagacaaagaaggacattagattcattcactggggatccttattaaaaatttgtatatacatgtgtgtatttatgtgtgtgtgtctcatattggggtttcagctatataaagcaaatactaacaaaactgaataaacacaaagagagcaatacaattatagtaggatatttcaatactccactttctgtaataaaacaagagagaatattagtaaggaaacagaagactagaaggcagtaaaaaaacaattatttttaataaggtatagagaacactcctcgacaacatcaggatacacagccttctcattacctcatacaactttcttctttatagac

SEQ ID NO: 338272 - DNA, 431 bp, Homo sapiens
ttattaaaaataatagttttttgactgccttctagtcttctgttaccttactaattttctctctgtgttattacagaaagtggagtattgaaatatcctaggggatccttattaaaaacctatggggatccttattaaaaatttgtatatacatgtgtgtatttatgtgtgtgtgtctcatattggggtttcagctatataaagcaaatactaacaaaactgaataaacacaaagagagcaatacaattatagtaggatatttcaatactccactttctgtaataaaacaagagagaatattagtaaggaaacagaagactagaaggcagtaaaaaaacaattatttttaataaggtatagagaacactcctcgacaacatcaggatacacagccttctcattacctcatacaactttcttctttatagac

SEQ ID NO: 338273 - DNA, 261 bp, Homo sapiens
tgatgaggcatgtttattctcacttcttgactggtgctcaatgatgtacaaacctgattccacaggctccattatcaaccaaaattaaggctgtttaggaataaataaattttttgagacaggatcttgctgtgtcacccaggctagaatgcagtgacacaatcacagctcactgcagcctcaaccttctgggcttaagtgatcctcccacctcagcctcccaaatagccaggactacgggtgcatgccaccacatcagct

SEQ ID NO: 338274 - DNA, 153 bp, Homo sapiens
acggcctaaagaagtgactccgccttggcagcctcacgggcaaggaggcacctttctcctaggtcagatccaggagctcagggagcttgcatttccaggaaacgtggacggaagcagaaaagtccccaatccaggtgcaagtcaccttgatga

SEQ ID NO: 338275 - DNA, 547 bp, Homo sapiens
gaaagatgtttgtgtgtgagggtaggtgggctctgtctactctgcttcattctttgaaactagatgttcctctgaaacctctagtgctctgtggagtgtgagaacaactgcctggctagccagggctatgtttggagtttaagtttgttattcaaattactgaatctgctgctcacagaggttggtacctccccagagaatattacctgttccaggcctttgtttgaatgagataatattgtaactatcacaaaagtttagctgcttttgggaagaagtccaaaatccacttactagcaaatgaaacattattctactgcttaggatcaaacagcagattttatgttcaattaaaactgactgtagtctcaatttagatagcaattgcacaagcagaggattagaatttggctcagatcctcttattaaaattcatattactcagtagcttaaatagtgaaagtcagtctatccttcactaattactcccttcttttttcctttgagcaggagaagtgtgtttggatacataagaagaaagttccca

SEQ ID NO: 338276 - DNA, 689 bp, Homo sapiens
gaccaaaatcacacaggtgaagtaagaggctgtgaggctgggatccagggtcctctcatcctccaccctgtggattttttcaatcaaactgctatacagttctggactcagtgggcacatgggtgaaggaagcgaagaagaactctgccctcctggagttgatagtctagctggagagactatttgaagagcaaactaataattctgcaagatgagaaggaacctacaactaaagatttgtggggggagttttccaggcaaagaaaaggttttgcaaaagctctgaggaggaaaacttcagtttgagaaactaagcagtggtcagcgtctgtgtgagccagtgggtgatagggtggcatgaccctggagagtagctgagggccagatcatgtttggactgctcttgaaaagtttcctttaaccttggactggcagtctttaaaggttggtaccctaacttgatgaaagaagattgtcttagtccattttgtgtttctataacagaataccacagactgggtaatttataaagaaaagaaatttgtctggctcgtggttctgaaggctggaaagtcccagggcatggtgccagcatctggggagggtcttcttgctgtgtcaccccacggcagaaggcagaaaagcaagagagcatggtagccagcaagcaagagggggctgcactcaat

SEQ ID NO: 338277 - DNA, 505 bp, Homo sapiens
tctctctctctctctctccaaagtgttcttcccataatgtgaagaggagaaagatcttttaaatctttttatataaaagaataatttacaagttacagatgctcctcaacttatgatagggctaagtcccaataaacccatcataagttgaaagtgtccctaagtagaaagtgtacttaatacaactaacctaccaaacatcatagcttagcctagactaccttaaacatgctcggaacacttacattgcctacatttgggcaaaatcatctaacacaaagcctattttataataaagttttgaatatctcatgtaatttatttaattttgtactaaaagtgaaaaacaaaacaattgtgtgattactagaagtacggcttctactgattgcattttgcttttgcaacattgtaaattcaaaaactcctcaatcaaaccatcttaaatcggggactgtctgtagaatctaagctgaaaactccttctccccattggacagaaaac

SEQ ID NO: 338278 - DNA, 470 bp, Homo sapiens
ttcctgaaaggggaatttattcagatgtgaagggaaatcaaccagtattatcctttgttcctattttcccttcttctccaccttgatagttgtgatcaaaattctcaggttaaatttgacattcagctatccatggctttagtatgagccattctgtttttctcaatatctatctatctatctatctatctatctatctatctatctatctaactatctatctattatctatagtctgcctattacttgtctacctacctatcatctatctctatcatcaatcaacaaatctatctctctacctgtctatatctatctacctacctatctatgtatctatctatcatctatctgtcatgcatctgcctatcacctatctacctacctatcatcatcaatcagccaatctatctctctacctacctatcatctatctatcaatctatctatgtatcatctgtctgcctatc

SEQ ID NO: 338279 - DNA, 421 bp, Homo sapiens
tattgctctatgacacctcaagtccatctaaattagcctgggaattgaccttctgttcaaagaaatcacagctatttaaggaatgacaacttctaagaaagattattttctagtatattaaggcatttgtacttccaaactgatttacagtgaacatcagattataaacctatttattatcactgaatattagcctactcttagacactaatgataattctttctgaatacatcagtttaaccttgtcattcccctacataggaaccatcaatagcttcctcctacttataagggggggagggggagagtcaaatctgtccatcaggcattccaatcttcctaatctcatcactaccaactcttgccaaagccttagctcaaaccggctgtcaacttcctgttctttgaactcaccgtaat

SEQ ID NO: 338280 - DNA, 254 bp, Homo sapiens
atgggaaaactaaggcgagcagcaggagaaaaggcggggggtctgctcctagctctgcctgatcccaaaactttattttgttccttctcccgtgcattttgtgttgaaaatataacaaattatcaccggagacattaagtgacctaaagttactagaaatcagggctggctgaggacagtgggcagcagtgtggctttctgaatggcccaccctgctgcctggcaccaccccatgtgaaatattgatttttcga

SEQ ID NO: 338281 - DNA, 373 bp, Homo sapiens
ccacagggctcaaatgttacgcaaccaaaggagctgtttttaaagactctccctacccagttcaagaggtgggaaagggaaggtctacgtggctggccagccttgcttctccctgagggactgggagataactgttttctccctcgtttgtaaaaataacttttttggtgggtgggaaggaagtgaccaaacttacattttgagcctgacaacatgtcagcgtcatcctaaaaataggaggtttcctttgttcctcacaaatgaaaagtttcctacctccaagccaggcagagtacagccgcagagtctgaattcacgcagacgcgggcaactgcacttggcaggcaccaggctccccctcctctgaagggag

SEQ ID NO: 338282 - DNA, 477 bp, Homo sapiens
ctaaatccagctttctctatatctctttccaggaatatctattcagtcagctcttttagaaaatgtatgaaagagtgaggactaaagttaagaaccagagaatatgggtaagaagaatgagtcacaggacaattagcaacactttaaacaattttttagaatgagtggagtgttggcatgtacccagagttactatctgcaggaataaatgaataacattacccaaattctgccatctgtatttggacggtagcccagattaggctaggagcctttgagggtggcctcattaagtagcacctgacatccatttctttcattatcttcttttctcccttttggtcttcgtttcttgttccctgtctcctccttttccctcttttaaagctgtccttcctttagacttgccaatcatcatcatagatgcaggcccagtccctggaactcgaggctaaaagaggtttctggttgctaaca

SEQ ID NO: 338283 - DNA, 749 bp, Homo sapiens
agcggcttcatgccctggtgctgtcagagcagcacgtggggcctggggaattctctctcctgcctttatggtttgaaacggtgtccctcttgccacctctgagatgactaggtgcgcatttgccggctgagtctgcccttctaaaaaatcccagctcccgcggcccaggtccaggtgtgcctggaggaacacctacctcctcacctgacggcccgcgtgtttctggtaggtgccccttacagcagagtgcaggcttccctgctccagggagctgtgttttcttttttgtggccccctcgattattccctgtggagatggctgcagccgagccgcagtgggctggatgggcggtgtccatgcagggaacacagtgcttggatgctgtcctgggaaaggtggcggcgtccgtttccccagcaggtgtcttgctgagcacctgtgacgagcctgtcctgtcctatagtgtgtaatgtgtggggccttctccacacaggctggggctgtggagaagactctttttgacatttcccctgctccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcgtaagtgcacaggctttggggacctggaggcggtggc

SEQ ID NO: 338284 - DNA, 4913 bp, Homo sapiens
ggcgacagtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcagagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338285 - DNA, 5548 bp, Homo sapiens
ggcgacagtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcagagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaaggagacttctcatatcttctcagtctcccagtgactgaggttccggaatcatcgatgtctatgcagtgatcgtatgcagtgtagacgagtgtggcaaagcgaccagggtctgcggcgaccggaagcccccagacccacaagggaagggtcagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtgtggtggggctgtgcctgggactcctaggggaagacccggggacctgaatggagggcagttagcctgcatttaggagcgagttcctcaaatcaccagcagtcttccaaaagccccagggcggtgacaggtaccatcccatagttgggtgggcccgttgtatctttagtagctggagatttagcaaagtttctcctgagtgtgggaaagggtgttgtgcccagggcttttcatggtaatgttagacagctcagtctcggaaataagtgtgccttcgagtccaagtaacgcgtcacactggctgagcactggttcccatccttgtaccgggcgctgaagtcaaaggcaggccttggatgcacccgcagggctcccctgccttgtcagctccccttggaaataaacacgaccatgcagagaggttgctggtgagagcgtgggacagcccgggggtggatgctgggatttggatgcttatttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338286 - DNA, 3274 bp, Homo sapiens
  misc_feature (49)..(49): n is a, c, g, or t
ccggaggccttaaccctggaggctgggagaccagcagaaggtgtgagtncaggctagacacattggcggcttggaccaaggtgggacagtgaaggtggaggcaagtggactggacatgttcccgtgggtttaggggcagaatcaacaagacttggtacgtgcagtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtgtggtggggctgtgcctgggactcctaggggaagacccggggacctgaatggagggcagttagcctgcatttaggagcgagttcctcaaatcaccagcagtcttccaaaagccccagggcggtgacaggtaccatcccatagttgggtgggcccgttgtatctttagtagctggagatttagcaaagtttctcctgagtgtgggaaagggtgttgtgcccagggcttttcatggtaatgttagacagctcagtctcggaaataagtgtgccttcgagtccaagtaacgcgtcacactggctgagcactggttcccatccttgtaccgggcgctgaagtcaaaggcaggccttggatgcacccgcagggctcccctgccttgtcagctccccttggaaataaacacgaccatgcagagaggttgctggtgagagcgtgggacagcccgggggtggatgctgggatttggatgcttatttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338287 - DNA, 3299 bp, Homo sapiens
  misc_feature (3292)..(3299): n is a, c, g, or t
ggcgacagtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcagagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaaggagacttctcatatcttctcagtctcccagtgactgaggttccggaatcatcgatgtctatgcagtgatcgtatgcagtgtagacgagtgtggcaaagcgaccagggtctgcggcgaccggaagcccccagacccacaagggaagggtcagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggagagacttccctgtgcctcatgatggaggacagacaagggaagtgttcctaacttccctgcagcccgggaggaggagagtgaagaggcgcatttcttctcggcccagcaccatgactttgtagaaaatggtgccccgggattgctcgttagagggcctgagcaaagccctggacttcactccacgtccaggactgtggtgggtgggacaggtgggttgggtggctcaggagggtcccacctgggacgttccaggggcttcgactgaggcctatgctgggataggggctgctgatggggtgtcaagggacacaaggctgggtgcctgcctgtgcgcacctcagggcagaggaccgacatgggaccctgtagggccagtgacaagctcactgaacctcccgagggtcctctggaacgtttgggatttttcagggcagaattgaaaacacaataaaactaagccgtgtgatgtttctgaannnnnnnn

SEQ ID NO: 338288 - DNA, 272 bp, Homo sapiens
agatcaatgcctttcacttgaggcggaacagagcaccacttcactctccctagaaaagtccttttcctgtttgtggtgtttctaacattctctgttaattggctggtttgactggaagcacctttgctttcagctatcagttgatcacattgtgttttcttcaccagaaaacagacacatgaccctcattgagaactgcagcctgcagtacacgctgaagccacacccggccctggagcctgcgttccaccttcttcctgagaaccttctgg

SEQ ID NO: 338289 - DNA, 474 bp, Homo sapiens
gccacatcatgggcttcacgggcccaggaggaaaccgggagaattctcaccagcttggccatggagcctgtgtccttggccgctgagtctgtcctggacccagttgtttgcattctgaatttctgattggggttagaggtcatcagtcatctcgggctctcctgcatgttgttgtttgttgctatccctggaggatctccgggacagtcctcaaatacagtgactgggttccaggagagacttccctgtgcctcatgatggaggacagacaagggaagtgttcctaacttccctgcagcccgggaggaggagagtgaagaggcgcatttcttctcggcccagcaccatgactttgtagaaaatggtgccccgggattgctcgttagagggcctgagcaaagccctggacttcactccacgtccaggactgtggtgggtgggacaggtgggttgggtggctcaggagggtcccac

SEQ ID NO: 338290 - DNA, 193 bp, Homo sapiens
cgccccggaaccacccatgaccttgggctcccctggctgattgggctgcaggcgcccaggagccccttgcttgcacatcctgagaggctgtgctctgacccgcctctctcgctcttgaagacagaccccaaaggtgtcttcgtgctgccgcctcgtggggtgcaggacctgcatgttggcgtgaggcccctta

SEQ ID NO: 338291 - DNA, 218 bp, Homo sapiens
gtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338292 - DNA, 753 bp, Homo sapiens
ggcgacagtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggtacctgccttgtttctacaaccctg

SEQ ID NO: 338293 - DNA, 3039 bp, Homo sapiens
ctctgaggagcctggtctgcctgaatggggatgacatttcagagatcaggatatggggtgctttgattctgggtcttcttgcttcaaaacctttcaccaggaagagctgggaaaatgtaaaatcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtgtggtggggctgtgcctgggactcctaggggaagacccggggacctgaatggagggcagttagcctgcatttaggagcgagttcctcaaatcaccagcagtcttccaaaagccccagggcggtgacaggtaccatcccatagttgggtgggcccgttgtatctttagtagctggagatttagcaaagtttctcctgagtgtgggaaagggtgttgtgcccagggcttttcatggtaatgttagacagctcagtctcggaaataagtgtgccttcgagtccaagtaacgcgtcacactggctgagcactggttcccatccttgtaccgggcgctgaagtcaaaggcaggccttggatgcacccgcagggctcccctgccttgtcagctccccttggaaataaacacgaccatgcagagaggttgctggtgagagcgtgggacagcccgggggtggatgctgggatttggatgcttatttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338294 - DNA, 2288 bp, Homo sapiens
agcggcttcatgccctggtgctgtcagagcagcacgtggggcctggggaattctctctcctgcctttatggtttgaaacggtgtccctcttgccacctctgagatgactaggtgcgcatttgccggctgagtctgcccttctaaaaaatcccagctcccgcggcccaggtccaggtgtgcctggaggaacacctacctcctcacctgacggcccgcgtgtttctggtaggtgccccttacagcagagtgcaggcttccctgctccagggagctgtgttttcttttttgtggccccctcgattattccctgtggagatggctgcagccgagccgcagtgggctggatgggcggtgtccatgcagggaacacagtgcttggatgctgtcctgggaaaggtggcggcgtccgtttccccagcaggtgtcttgctgagcacctgtgacgagcctgtcctgtcctatagtgtgtaatgtgtggggccttctccacacaggctggggctgtggagaagactctttttgacatttcccctgctccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtgtggtggggctgtgcctgggactcctaggggaagacccggggacctgaatggagggcagttagcctgcatttaggagcgagttcctcaaatcaccagcagtcttccaaaagccccagggcggtgacaggtaccatcccatagttgggtgggcccgttgtatctttagtagctggagatttagcaaagtttctcctgagtgtgggaaagggtgttgtgcccagggcttttcatggtaatgttagacagctcagtctcggaaataagtgtgccttcgagtccaagtaacgcgtcacactggctgagcactggttcccatccttgtaccgggcgctgaagtcaaaggcaggccttggatgcacccgcagggctcccctgccttgtcagctccccttggaaataaacacgaccatgcagagaggttgctggtgagagcgtgggacagcccgggggtggatgctgggatttggatgcttatttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338295 - DNA, 2024 bp, Homo sapiens
ggcgacagtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcagagttcccgttggaggccggtatctcccacctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtct

SEQ ID NO: 338296 - DNA, 412 bp, Homo sapiens
caagataacggagcacattgaaataagagacagacgtatggaaacagttttgaaaatatgggaaaacatgtacacatacacagaatgtgatctacaatgtaatacatccattgtatatttaacagttaaaacatggaggaagagagtctatctctaggtagctgattgcattttctcctttatattattttgtattttttccttcatgagcgtgtggtccccttatgataagagagctagtattttgcagtgtaagcaagtcctctttgaccctgtctcttttgtggacttgcaagggactttagttggtggccataaggctgcttggaagtctttttgagcacacagatggtcttttattcctcctgacttcttcaaatcagcttctgccttgatcttatggtaaaggacc

SEQ ID NO: 338297 - DNA, 283 bp, Homo sapiens
gtggggctcttgaatccctagctcaggagaatcaaggagcaggtggtgcctgggaggctaaacactgctaagtctgcatttattcctttagctgtatctgtgcattaattcaataagatggtctaataaaataatgcattttcaaaatgcttagctggcatttggggagggggtgggcattttcattatttactaaggaatgcattttgaaggaatttgtgactgaagacagcttgcgctgtaggctgctctcgcctccaggggtcacccttccctttaatga

SEQ ID NO: 338298 - DNA, 101 bp, Homo sapiens
gtcccagaaagaccgcaagaacccgctgccccccagcgttggcgtggttgacaagaaagaggagacgcagccgcccatggcgcttaagaaagaaggaataa

SEQ ID NO: 338299 - DNA, 309 bp, Homo sapiens
aagatgttttaaaaacaaatgtcaacggatggctcaaagcccacttgtgagaatctaaggagacagcagcgttagtgccacctttttcttaacttttcatagcccatgtatctttccactggatggcatccaatgacattttgggggccagagaagggaaggaggtcatgttggagaaggcagcatttctggattacagaagcattataggaaatgatatattgagatgtaaacagggaaagaggttttttccaatttgttctttttcatgaaatttaccaggtcattttatcttcaagtccaaatcta

SEQ ID NO: 338300 - DNA, 384 bp, Homo sapiens
taagttagccctgacaggaagattgcagtctagttggaaaggaaatactaaaatatgcaaaacaataattttatgttgtggatctattctatacaaggaattaatgtatcaagggataaaagtataaggcacaatgactatcctcagactgctaatagtctagtagaggctgagacagagaatttcaaagtctacaagttttgagatgagttgagtattaattcacctgccacaagagccgtgaggtgtagagcaagcttgtccaacctgcggttcatgcggcccaggatggctttgaatacagcccaacacaaatttgtaaactttcttaaaccattatgagggtttgtgtgtgtgtgtgtgtgtgtgtgtgtgtgtgtgtgt

SEQ ID NO: 338301 - DNA, 441 bp, Homo sapiens
ctcagatctccttcagataaaaataattaaacagaccaggcacggtggcttacgcctgtaatcccagcaccttgagaggccaaggcaggcggaccacccgaggtcaggagttcgagaccaacctgaccaacacggagaaaccctgtctctaccaaaatagccaggcatggtggcgcatgcctgcaatcccagccactcgggaggctgaggcaggataatcgcctgaacccgggaggcagaggttgtgatgagccgagatcgtgccattgcactccagcctgggtgggcaacaagagtgaaactctgtctcaaaacataataataataaaaattaaaacagtatttctcattcttacagccgctcaccatcttctctcaatcctgatagccactgctgcctaaataactaccccatttttgaatagttattacaattctttt

SEQ ID NO: 338302 - DNA, 369 bp, Homo sapiens
atcatctttcatattggttaacctacactaaaaagcttttatgccagtagctttaaatatattgcctatttactgcttacagcaatcctcaaagagttgtttatggatgacaaactaaatgtcaaagaagtaacctgttcaggtttacaagttcagggtccagttttgaacctaggccttcatcctctagagcccaccacctgtcacagtggatgttatcaacttttcacaagaatacagtctctttactattcagatgttatcctgtactggcacctctggagggctattgataatggaagtgcagagatctttgcagataatagcaggagaataagaagagatttggggtagggggcagaatctata

SEQ ID NO: 338303 - DNA, 177 bp, Homo sapiens
cctacgccaaggagtaccgaaagtacctggagctgaacaacaatgacattgcctcctttctcaaaacctaccagacgcagggcctgttggcccaggaggtgcgggaggtagtgctcacccacctgcgggagaaggagatcctggacagctcgctgcccagcagcatcatcattgggc

SEQ ID NO: 338304 - DNA, 719 bp, Homo sapiens
aagagacttaggtcattatatcatctgtaacttctagcaatgcagcagaatgttatgtatttaatgtgcataaaataaatgcattataattcaaaatgtaaccaaccagaaaacgaagagaaagttttcaagatggcataaaaatgtggcaagtgtttctgtttccatgccatacatttcttgcctccaagcaaatattcacattattctcctctctggaatacagtctcttcatcaaacacaactcttacccatcctttatataatccagcttctccattaagccttcctgtcatagaaagtataacaatgccacattttcatattgttccttctcttaatatctacagcacttattactacataatccaatccttaagtattgagtttttttcctcctaacaccaaatacatgatgtcttttccaataccacttctccgactctctgacatcaactaggtgccctacaattcaattctgacactacccagagttagcatcagactccacagatttaagtctcacaagactgccattacttcatacaccagtcacaagcatggggttccccaatcctctgattgatcaactgaccagcaataattgggggctcccaggccccctcctccagttaggtaatttggtgcaataactcacagaactcaggaaagcattttcttactagattattattataaaggatacaacccaagaacca

SEQ ID NO: 338305 - DNA, 827 bp, Homo sapiens
aagagacttaggtcattatatcatctgtaacttctagcaatgcagcagaatgttatgtatttaatgtgcataaaataaatgcattataattcaaaatgtaaccaaccagaaaacgaagagaaagttttcaagatggcataaaaatgtggcaagtgtttctgtttccatgccatacatttcttgcctccaagcaaatattcacattattctcctctctggaatacagtctcttcatcaaacacaactcttacccatcctttatataatccagcttctccattaagccttcctgtcatagaaagtataacaatgccacattttcatattgttccttctcttaatatctacagcacttattactacataatccaatccttaagtattgagtttttttcctcctaacaccaaatacatgatgtcttttccaataccacttctccgactctctgacatcaactaggtgccctacaattcaattctgacactacccagagttagcatcagactccacagatttaagtctcacaagactgccattacttcatacaccagtcacaagcatggggttccccaatcctctgattgatcaactgaccagcaataattgggggctcccaggccccctcctccagttaggtaatttgaagcatgggagacccaagtgaataaaatgtagtagacatttaaatattgcaagaatattaatatagcacctgtaatattgtaaagcaactgttctgatggactacaaaatctaaggctattaaatgtaatactgatgactggttgaggtaatcgtgagggggggatctctagaatcacttgca

SEQ ID NO: 338306 - DNA, 107 bp, Homo sapiens
caagagagtcttcacggtagagtagtattttaacttgacttgaagggtaggctgatttttaccaggcagagatgagggagtacattctaggcaacaagaagaggaaa

SEQ ID NO: 338307 - DNA, 522 bp, Homo sapiens
catgtagtctttaaacaacgttagaaaggaagaataaaaggactaatggactgttaatgtagaagctcaaatgtgaaactgaaatacattatatctttgattacgtaaaagtaaatttagctctcttatcaaacataagttatttagaaataagagtgacaaagtataataatgggatgcatagattgaaatttcatacaaataacctagaatcattcacttgtaattaataaaaggcatgatgagaaataatatgaaaatgtcccaggtactgtcaacaccattataatttcttactatcttgtttgagaaaaatgaggtaatggcagaaaggattcaagagctctgttgaatgttccatttttgtacaaaaacaaacagaaaaagagttaccaaaaaaaagttttaaaaattcattgaaaccaatatttcgaaaatgtgaatcaagtaaaatatgtgagatatttattatttaaaagaccatttgtgctagtcaatggttggtttaaaaccacagaacaa

SEQ ID NO: 338308 - DNA, 892 bp, Homo sapiens
  misc_feature (774)..(774): n is a, c, g, or t
  misc_feature (781)..(781): n is a, c, g, or t
tagtagagatggggtttcaccatgttggccaggctggtcttgaactcctgacctcaagtgatctgccagccttggcctcccaaagtgctgggattacaggcgtgagccaccacaccgggcctagaaaagattttctactaaatttctttataaactccagttcatttaatatgcaatttgatttataattcttctgccaacaaagattaaaattatagtcataaaagtttttaaactagaatcttttatctgaagagtccaagaacccagagaggctatgatttgccgaagatccataggaaattaactgcagagctggaaagagaacttgaggtatgattaccagatttatattttttcagtagcaactaaataaaaggttcaatttcatttttctctagggtactacctttagatttactaatgaggaaggacatggaagataaagcagggcaaagcatgggtaattcacaatctgaaaaatcaatttgtgaatgagaaacctgacctccactccattccactccctcactctgtcacccaggctagagtgcagtggcacaatctcggctcactgcaacctctacctcccgggttcaagtgattctcctgcctcagcctcccgagtagctgagactacaggcgtgcaccaccacacccagctaatttttgcactttttagtagagatgggctttcaccatattggccaggctggtcttgaactcttgaccttgtgatccacccacctcaacctccagccatttccccatttngaagagncttgaaatacacaaagatatttacttatttgtaatgaatctgagcatatgttgctgttttttcgaaactcttatccttgcaggtaaaattaccgtggacgggatcgtctag

SEQ ID NO: 338309 - DNA, 369 bp, Homo sapiens
ctctgcctgggagaggagggacagagtgcaggagccccagcctcggcctgccgggcctcatcactctacctaatggagcaaaatggctcgcggtgattctcgcaaaggttagcaaggtcagaaacggggactgatgtgacttcatttgctaaatgctgagttgaacaagtacagagatttctcccaccaaagtcctgtgcattcacggtgctggggtgcacagagccctagctgaagaggagtaagggcatgtcccagacaccggaacacatgttctagacttatccaggtgtcaacaaaatcccaaggccagaaaattccatacagagaaccacagacggcaccgaggagtgggaagcaaagactctg

SEQ ID NO: 338310 - DNA, 1466 bp, Homo sapiens
tggttgaatagtgttctattagcaacaatatatgaaatactagacacacccattaaaagtagaaaatacccactactgttttaaaattattctgcaagatctcactaatgcaatgagacataaaacagaaataatgggtgtaattattgaaaattggagataaaatttctattacttgcaaacaaaattctctatgtcaaaaacctgataagttaaacaatacagttaatatgtttaatagaactaattagatatgagaggcatccaaaatccattttttctatacaaacatggtttgatatatacagtcttgttttatctgtgtattaattggcttatgaaataatagaaaaatcaagtatgcattattaggttaaagaagcaggagagacagagctataaaaactaagaagaatgttgtaaggagggcttagcaaccaggataaatgttgtagagagatcaattaaagtgatggcctagagatcatgggcttcctttggcagagccatgttggtgaagtgaaggaagtgtaagccagaccacagtggttgaagaatgaatgtaatgtaagagccaagacatttatttgagtttgatagttatgaaaaagaacgagaattttcttattgctgttgtttttgccatttcatgttcaaaaccctttatctcccatgtgggactgaaaactcctccaagacaggatctctgtttctgtgaggcctgtagtacttagtacatccttgaatgtgtgaggctctcattggttataagtttaattcctgactgtggatgaaagctttaaaactttgtgggcaaaatacagaatgaatttcagtgagttcccatgtattaaataaggtggtgctggctggagatatgctgtccctgtgcccacaatagtagtggtgctgtgcttatcttcctgacgcgctcttcgcagtcttcaccgcctttcttcaggagtctccccttgggctttttcacagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgtgagtagatccagttttagaaatgtctaaatattgtgttttcaccagtggccacattcaacttatgacttgattaagggtgaaatctttacagaattagggcagtaatcatgtggcagaattgggttgtcaaatagtccatacatacattaacttagctttgtggcttgtgtgcagctgccttcaacattctctcacctgggttagaattagaggactatggttactatattg

SEQ ID NO: 338311 - DNA, 267 bp, Homo sapiens
taaagctcactgttgcatatacaaatgtagatgtgcagaggcaatatataccaaaacgggtattctgacaagcgatagatatgtaagaaatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338312 - DNA, 3659 bp, Homo sapiens
aactttatttcctcacagttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338313 - DNA, 3855 bp, Homo sapiens
aactttatttcctcacagttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaaaaaaaacaaaaacaccacacacaaagaccaaacgaaaaaaagccccaccagcacgccaaccctcagcaccaaccccgcccaaacacccctacagccaccaaaaacgggggggggcgccctaaccccccccggggcccacaacccccccccccgctctcgggcgacggccgccccccagctgcggccatatcaaccc

SEQ ID NO: 338314 - DNA, 5676 bp, Homo sapiens
tggttgaatagtgttctattagcaacaatatatgaaatactagacacacccattaaaagtagaaaatacccactactgttttaaaattattctgcaagatctcactaatgcaatgagacataaaacagaaataatgggtgtaattattgaaaattggagataaaatttctattacttgcaaacaaaattctctatgtcaaaaacctgataagttaaacaatacagttaatatgtttaatagaactaattagatatgagaggcatccaaaatccattttttctatacaaacatggtttgatatatacagtcttgttttatctgtgtattaattggcttatgaaataatagaaaaatcaagtatgcattattaggttaaagaagcaggagagacagagctataaaaactaagaagaatgttgtaaggagggcttagcaaccaggataaatgttgtagagagatcaattaaagtgatggcctagagatcatgggcttcctttggcagagccatgttggtgaagtgaaggaagtgtaagccagaccacagtggttgaagaatgaatgtaatgtaagagccaagacatttatttgagtttgatagttatgaaaaagaacgagaattttcttattgctgttgtttttgccatttcatgttcaaaaccctttatctcccatgtgggactgaaaactcctccaagacaggatctctgtttctgtgaggcctgtagtacttagtacatccttgaatgtgtgaggctctcattggttataagtttaattcctgactgtggatgaaagctttaaaactttgtgggcaaaatacagaatgaatttcagtgagttcccatgtattaaataaggtggtgctggctggagatatgctgtccctgtgcccacaatagtagtggtgctgtgcttatcttcctgacgcgctcttcgcagtcttcaccgcctttcttcaggagtctccccttgggctttttcacagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccaaaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338315 - DNA, 4855 bp, Homo sapiens
tgagaggagtggggcaggctcggcgccggtaggaagagtcagaggggtgaccagagagcccaacgcctggtgctcaagactttctccgagtgccacatgcttgttggagagagagaaggcaagatcagggctaccaactgtagctgtgcaggttttgccatgcaagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccaaaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338316 - DNA, 3510 bp, Homo sapiens
aactttatttcctcacagttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatcaggtggcttgggactggtttcaacatcacaggaaggaattttaaggggtaacgcagataaatataggggagaaccgggaaatgggggcgcaactgtttgaagaggttataaagggaaactggggggataagacacacagaagaggtgtttttatggagagttgaaacaagcggtc

SEQ ID NO: 338317 - DNA, 3655 bp, Homo sapiens
aactttatttcctcacagttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgttaccgtccctccccctcccgccctcccccccccacccccccccccccctcctcgcctaaagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338318 - DNA, 815 bp, Homo sapiens
cataaactattacagcataaactatggaaaccttctggacagcataaactattatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338319 - DNA, 1937 bp, Homo sapiens
tggttgaatagtgttctattagcaacaatatatgaaatactagacacacccattaaaagtagaaaatacccactactgttttaaaattattctgcaagatctcactaatgcaatgagacataaaacagaaataatgggtgtaattattgaaaattggagataaaatttctattacttgcaaacaaaattctctatgtcaaaaacctgataagttaaacaatacagttaatatgtttaatagaactaattagatatgagaggcatccaaaatccattttttctatacaaacatggtttgatatatacagtcttgttttatctgtgtattaattggcttatgaaataatagaaaaatcaagtatgcattattaggttaaagaagcaggagagacagagctataaaaactaagaagaatgttgtaaggagggcttagcaaccaggataaatgttgtagagagatcaattaaagtgatggcctagagatcatgggcttcctttggcagagccatgttggtgaagtgaaggaagtgtaagccagaccacagtggttgaagaatgaatgtaatgtaagagccaagacatttatttgagtttgatagttatgaaaaagaacgagaattttcttattgctgttgtttttgccatttcatgttcaaaaccctttatctcccatgtgggactgaaaactcctccaagacaggatctctgtttctgtgaggcctgtagtacttagtacatccttgaatgtgtgaggctctcattggttataagtttaattcctgactgtggatgaaagctttaaaactttgtgggcaaaatacagaatgaatttcagtgagttcccatgtattaaataaggtggtgctggctggagatatgctgtccctgtgcccacaatagtagtggtgctgtgcttatcttcctgacgcgctcttcgcagtcttcaccgcctttcttcaggagtctccccttgggctttttcacagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccaaaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggtatgaaacggcaactaagtcttcagcttctgagaaaaaaacatcttctcaataggattgagaaggaaaaccgaaggatttcatttccattaaaacttatttcattttttacat

SEQ ID NO: 338320 - DNA, 3605 bp, Homo sapiens
aactttatttcctcacagttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtctttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338321 - DNA, 4779 bp, Homo sapiens
tgagaggagtggggcaggctcggcgccggtaggaagagtcagaggggtgaccagagagcccaacgcctggtgctcaagactttctccgagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccaaaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 338322 - DNA, 3387 bp, Homo sapiens
aactttatttcctcacagttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatata

SEQ ID NO: 338323 - DNA, 2604 bp, Homo sapiens
tggttgaatagtgttctattagcaacaatatatgaaatactagacacacccattaaaagtagaaaatacccactactgttttaaaattattctgcaagatctcactaatgcaatgagacataaaacagaaataatgggtgtaattattgaaaattggagataaaatttctattacttgcaaacaaaattctctatgtcaaaaacctgataagttaaacaatacagttaatatgtttaatagaactaattagatatgagaggcatccaaaatccattttttctatacaaacatggtttgatatatacagtcttgttttatctgtgtattaattggcttatgaaataatagaaaaatcaagtatgcattattaggttaaagaagcaggagagacagagctataaaaactaagaagaatgttgtaaggagggcttagcaaccaggataaatgttgtagagagatcaattaaagtgatggcctagagatcatgggcttcctttggcagagccatgttggtgaagtgaaggaagtgtaagccagaccacagtggttgaagaatgaatgtaatgtaagagccaagacatttatttgagtttgatagttatgaaaaagaacgagaattttcttattgctgttgtttttgccatttcatgttcaaaaccctttatctcccatgtgggactgaaaactcctccaagacaggatctctgtttctgtgaggcctgtagtacttagtacatccttgaatgtgtgaggctctcattggttataagtttaattcctgactgtggatgaaagctttaaaactttgtgggcaaaatacagaatgaatttcagtgagttcccatgtattaaataaggtggtgctggctggagatatgctgtccctgtgcccacaatagtagtggtgctgtgcttatcttcctgacgcgctcttcgcagtcttcaccgcctttcttcaggagtctccccttgggctttttcacagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccaaaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatggtaacagtactgtcccctcactggctctctgtttagtctcccagttttttcaagcattggttctatagaactggtgtctggagagcaactttaggcagtagtaataaagtggaagaggtgtcttgttgtcttccc

SEQ ID NO: 338324 - DNA, 109 bp, Homo sapiens
cccttatcttgcagactatatgtcggaaaccaaagacctccactgatcgacacagcttgagcctcgatgacatcagactttaccagaaagacttcctgcgcattgcagg

SEQ ID NO: 338325 - DNA, 172 bp, Homo sapiens
aaaaaacaaagtttgaaagacactgatatagaggaagcgttatggttctgttatagatgagaactccagaagccctaactgagccacattggagaacagcaccagactgtgaagtctctgggctgtggtttcacaaatgtccccaggctccaatcccagtgcctccctgcat

SEQ ID NO: 338326 - DNA, 254 bp, Homo sapiens
ggtggcatggtgaggggtaccagggaaggacgaggacatgaaggcataaggttgggtaagacaggaacaagtgagacattaaacgaggctgtggtagagctgagccagagggcacagtaccaaagtgtcatagcaacaaagagggtgaggaggtgccctgaaaggacagcaccctcacaagctacagaagagatgtttccagagaccagggcaagcttctgtgcacacccatacctaatgcctctggagcagct

SEQ ID NO: 338327 - DNA, 140 bp, Homo sapiens
ctctgctgaagatggttgagaggatgactaagtggaaggctacgtgctccaggcatgcgggggtgggttatagaggcctgaggtccctgggatggggaagagggcagtgtttccttatcccaggaaccatcactgctgcc

SEQ ID NO: 338328 - DNA, 404 bp, Homo sapiens
gaagcctatgccttcctggtgaggggagtggaaggtaactgcactgagaaccccagcaaacctcacaaagccatgtcaggaagcaaagtggcagagccacagggagcacgggggaaggcaggatagagcacaggcagcatgtgaggagacagaagcagagacagggagaaacagagagacagagaaagaggaagagaacagatcccagattcaccagctgtgtctcaaggtcatctgggcaagtgacctggaaaccatcccaaaccatccagagatcagcagggtaaaccttcagccacccaggcctcctttcccacagccacaaaggtacataactccccttcccagccagacgccaccttagggaggaaaggggatgaattctggatgactaagcatttgcc

SEQ ID NO: 338329 - DNA, 115 bp, Homo sapiens
attaaatagccaaaatgaaagagtgaggtgctgagcttctggcaattcaccctgaggtatcacctttatataaagaccccaataagatatttgaatagagaaaaggcaatgaaaa

SEQ ID NO: 338330 - DNA, 748 bp, Homo sapiens
agtgctgggattacaggtgtgagccaccacacccggcctaccttttgttcttaaatgtaccctacttacttttgtatgttgctgtcttgagtgagcataataaaatcatttgtgtttttgctgagttacaaacctggaggagtgtatgcaaatgagatcacatggttgttcctcaagtgtttacaatattaatgcatattattaggtgtcacatagctcagatgtagtcttcaaatattaatctggtggtcataaatgcagaatatctagtatctagccttttcccttgcctcagagtttgtggtttaggagaaagaatcagatatgtggatgaaaacttcacattaaagaagtttcctttcaggaattggaagattggccacaactgcccatgttccagctgtgtctatccctcactcatgctaagcctgttctttagccttactgaggccacctgtttttttgttttgttttggggttttgccccattttgtattttgttagctctcttctttctttacttctttcctgactggatgtcatgatctgtcacttcaaacccctgtattgccaacatactttagtatccttgccctcttaccctctgaccgtgggtcagttgaactgtctatcctgtggactgctgagcactgctagcaaaacagcataatcttgcctctgcagcctctgctgagttctcatctcagcctacttaataatcctgctctcttttcttgggtagctcctt

SEQ ID NO: 338331 - DNA, 171 bp, Homo sapiens
ctgcccaaggttatgtaacttggcgatgagaaaaggaggacccaaacccagacctctcaagtcccccgtctgggccccttcatcttcttcacagcccacagcagctgccacctcggccgagcagccattttgatcgctaaagtgcctgcgggaagaccccatggccacccc

SEQ ID NO: 338332 - DNA, 192 bp, Homo sapiens
ccggacctctatccttaatctctctatccttagtctctctatccttaatctctctatccttaatgttcttccttagtctgataatgcggagaatgtgattttgagcatgtttttttgtgagcttttatggtaagagtccactagacctttgataatactttaatcgttcccataccagcttttttttttttt

SEQ ID NO: 338333 - DNA, 294 bp, Homo sapiens
aggggctggaacatattatcccattttcagcctgggataaaactggagggagcacccacaggcagggtcaggattcacaataggtgatggaagccttgaagttctattccacagagaacagaccagaaattttagtctggaaaataatcaggacacatttaatcagtcctccgtctcagtgaaaaatctcaagaatgtactcaaagaacaccgagtttcgaacaatactggttttcgtggatcccacaaaaagactggcattgttgtgaacaatctggccactttttttttttt

SEQ ID NO: 338334 - DNA, 248 bp, Homo sapiens
ttcacctaccccaaaaccatcaatggtttctcaatacctacattaaaagggtaaaaattctttgattaggcactccaagtccgtagacaagtcaattccaacctaaattttcaaatccatttctctgtacaccactccccatatacaccactccagggaaactgaactattctttcttatctgaatatactcttcacttcagatttttctttttctttacttttcctttttttttttttttttttttt

SEQ ID NO: 338335 - DNA, 204 bp, Homo sapiens
caggggtgagggaaccttagaattcaatcatcaggggaaaatgttggaggggtggctatagaggggatgatgagaaaatgtgtttcttgaccagtgattcagaatttttatgactagctttggctagttacattattagaaagtatacggtctgaagcagagagcttctgcttgcctggaacattaggatgtccagcttgttct

SEQ ID NO: 338336 - DNA, 979 bp, Homo sapiens
cttgagtccaggagatcaagaccagcctgggcaacatggtgaaaccccatctctactaaaaatacaaaagaattagccaggcgtggtggtgcatgcctgtggtgccagctacttggggggctgaggtgaaaggatctcttgagctcggtgagttgaggctgcagtgagctatgatcatgccactgtattccagcctgggaacagagtgagaacctgtcaaaaaaaaaaaaaaacttttttttccttttctgtgttccaaaggcagaacagaccaccagcggtatgaattttgcttcgtcttcacagacagacatggagcttgcaggaaagttgtttagagtaatcggacttttaacactggaaacagcacttccctgaatttgacttgagtttttttattaatattatgtttggatcatgagaagactcattcagacaggctgacttaagacattaaatgactagttaaccatatacactaatcacataaatatggtttgtggaatgatataaaatggtttacgaaatcatttttaagccatcttttcaacagtaattgtatcagtcctgtcatattttaaaccaagcgatattggcaagaatgagcctaaatgtctttaatattctgatgatgagcatgaaaaattgccactgcaataaaatgacagggttgtgttcatttctcttcttccatggcactttgctttcttccctttcaactttaaaacacacttcctaacatttcatcatgggagaaggctgcataagtttccagttgctgtaatttacttaaaccataaaattgtttccagattaccaaccataaaatggaaagacaatcttatttattaatgtataaatcagataatgtccccaatatgaatcctgaaaccagacacactttgacgattaaataggagggaaaatgttttctcattaccatatgtcaaaagaatggtatttttgtgaagtggctttg

SEQ ID NO: 338337 - DNA, 1039 bp, Homo sapiens
cttgagtccaggagatcaagaccagcctgggcaacatggtgaaaccccatctctactaaaaatacaaaagaattagccaggcgtggtggtgcatgcctgtggtgccagctacttggggggctgaggtgaaaggatctcttgagctcggtgagttgaggctgcagtgagctatgatcatgccactgtattccagcctgggaacagagtgagaacctgtcaaaaaaaaaaaaaaaaaaaaaaaaaggttctataaatggagtcattggctaaaaatcatcccctaaacacagattcttttttttccttttctgtgttccaaaggcagaacagaccaccagcggtatgaattttgcttcgtcttcacagacagacatggagcttgcaggaaagttgtttagagtaatcggacttttaacactggaaacagcacttccctgaatttgacttgagtttttttattaatattatgtttggatcatgagaagactcattcagacaggctgacttaagacattaaatgactagttaaccatatacactaatcacataaatatggtttgtggaatgatataaaatggtttacgaaatcatttttaagccatcttttcaacagtaattgtatcagtcctgtcatattttaaaccaagcgatattggcaagaatgagcctaaatgtctttaatattctgatgatgagcatgaaaaattgccactgcaataaaatgacagggttgtgttcatttctcttcttccatggcactttgctttcttccctttcaactttaaaacacacttcctaacatttcatcatgggagaaggctgcataagtttccagttgctgtaatttacttaaaccataaaattgtttccagattaccaaccataaaatggaaagacaatcttatttattaatgtataaatcagataatgtccccaatatgaatcctgaaaccagacacactttgacgattaaataggagggaaaatgttttctcattaccatatgtcaaaagaatggtatttttgtgaagtggctttg

SEQ ID NO: 338338 - DNA, 424 bp, Homo sapiens
ctccatggtaacctcagcctcttctggtagaaacttatttgctcagactgagagcaaaacaattgctttgtttctgttttctttcttattatgcctaggcacactgtctggactaggcctctcccagtctctcagaatgagaggtctctgtggctgcttaatctaaccttttgctagtgagggataatgacttgggaacagagagaaggtctatgagagactgtagcagggcttcacatgttttggaagacattcattcaacatgtgtaatgaccaattccaggtcaggccttattgcaaggactagaaatatagcccctatgactgccctgcctccttttcccaccctctcctgacctcatctacaaaatccccacccagggcctgcagcaggtgggcaggaagagccctgaggccacagctt

SEQ ID NO: 338339 - DNA, 6331 bp, Homo sapiens
  misc_feature (4346)..(4346): n is a, c, g, or t
  misc_feature (4530)..(4530): n is a, c, g, or t
  misc_feature (4723)..(4723): n is a, c, g, or t
  misc_feature (4765)..(4765): n is a, c, g, or t
  misc_feature (5067)..(5067): n is a, c, g, or t
gtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagnaaattttcttttttttaatttttaaaacttcattgtattttatgtttagagatggggcctcactacattgcccaggctggtctcaaactcctgggctcaagtgatcctcttgccttggcctgccaaagtgctgggattgccttttccgcccaccccccccgaccccaccagagacagggtctcnctctggtgtccaggctggagtgcagtggtgcaatcatagccttaaattcctgggttcaaccaatcctcccacctcagcctcctaagtagctgggactacagttatgcaccaccatgctcagcttattatttatttattttttgtagacatggggtcttgctatgttgcccaggcaggctgatctcaagctcangtgatcctctggactcagcctcccaaagtgctgggattatangtatgagccactgtgccccaccctcatacaaatttccatgttggcaactgtagctggatctttctggagatctctgaaagacagcatggaatccttgaacaccccctgaggcgtgaggcatccagagcatttatctgccaaccctcaggagctggcactcgtagacagcacgcacagccagctccattggtcttggcaaagagaattgcctcctggagccagaggccggttcctgtgcttagaaaggaaggacatgtcttctgtgctccctgtctcacaaggcctcttcagcaggcatgggnccttcattctcaagttcaaggaaccctgtggaaccttgtccttgtcctccagagagaatcctctccgccttagaggtccctcctctctctcacctccccaccaagcctccctgaactcaatgtcttctgtccccttccctgcccaacttccacttctctatgcccagcctctgtggcccagtaccattggggttctgtgggcagctgggtcctggtggttggggaccgtgggaaggggcctatctgtcggatcttagatggagcatccagaagccccacccttcatactggccagagtggcccctgccagcgcctctctggagtgtcattaagctgaaagtgtttgccttacctctgcagtaggatgcattactgaagtggcctcttggtcacctagctctgaattttcctggctccagaaagaggctgtggggcacaggtcccccacaatgaggctgtgaaggggagagaggcaggcctgggccaggcacaggaggacaactagggcttctcaggagctgtctcagccaagagtcacacacttgatacctaaaatggcttcaggaatcttccaagactgaagacttccccaggtgtggtctagggcctgcctgcctcagagccatgagcagagccggtcaaaaggcttcctagggaatcctaccccagacattaaaatagactcttggtgctggcaggtggctggaatctgcgtttgtagccaagtgctcttcctgtgtgactcagcaaagtgggggtgcatttggggaacacccggggctggggcctgagtcctccacccaaagccaggtttgattcttgcattcccctccctgccttccatccagacaggcccaaggatgcaagaggcgttgatcagcccatctccatccatgcctgttgcctcagagagggccgacggcttttaaaatgctgttgccatagcaacagcatccagccagtgggtaccacaggcagggagccacagaaactggggtgctgggatggaaactgacttgtgagagaccacagctactgctagaaggaaggggggcaaagcgggcacaggtaatctaagaatacttgggcgggaggagtccccaaggttaccttgtgcatccctctgtccccagaaagaactgtaccccaacaatctctcccctcactgcatcccctggggaagaagggaatgcagaaatgaaatgtcataatgagtaacaatgtataaaaatatcgaataataacagctaacatttcttttgca

SEQ ID NO: 338340 - DNA, 4073 bp, Homo sapiens
  misc_feature (4070)..(4070): n is a, c, g, or t
tgcacgctgcagagggtggtgcccacgtggagtggctggtggtcattgcagggcatcctggagtgaggtgactgaagtgcagggctctgagtccaggctgcgagacaggtgtggtttcccaaggcccgagcctctttccctgctgctgtatttgccctcccctttcctccccatgaggatgggctgtactggctcccggagcctcagcctcatgactcctgtggggagagtgaggcacaccgcccagattcctggaacaggaaatagcctgtcggaaacccagggttgaaagtctgcaagaagaaatagtgctggtggccacagggctgcacgctcaccaccccttggactggagacgagaacagagacagtgatcattgtaacgaccaacgattgagcaactcaatcattcactgagctcttgctgtgtattaagtgcttctcaggagctgtctgatttcatccttgaaataacctaataagctcagcatattattctccctgtttaacagatgaggaaactgaagctcagaggtgcactgacttgcccacagacacacagtgagtcactgcagagcagagacttgacccctttctgtgtgaccccagagctcatgccatgagctttgcctgcccacgtatcttatacagagggagtgctctgcacagaggagattcagggaagacttttctcacgaagtggtgtttgagctgggtcttgaaggataagtagaagtcagagttcacagaaggagaaggagagaaagggtgttccaggcaaaggaaccgttacggccaaaggtctgcaggccacaggagaggtccctagagggccccccacaagttctcactgctcacgtgtgccctctgtcctccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagtgcgttccagacaacagaggagcaggactggagcagatggagagggcgttagagggggtggcactgccagggcaaagctgtggaggtgggaaagagcaagaaaagttccagagacagtgagggaaccagcttggattgcagagttcagctgagatgttatctcccccagagattcttaccagatggccaagcccaaagaatattctgaatcccccagagggtttcttaaaatgcagtttccagggccccatcctagacctaataactcagcctcacagagccgggggttggagggcagggaagctgcatcaacgtgatgcgatgtgacaaggctctggaccacagggtgattcagccccgtatcagcgctcaggaattctcaggccagtggggagcgggggcgggggcggggacaaacagggaagcgcacagtaagggagaatgtggggactcagagcaggagcctttggagtcagagaagttttccagaaggaacatctaagcagagcccggctaggcaaagtgaactgccatggcgagggcctggagacttccagaagcgtgataactgctcttaattgttcaaccctcaccaggagctaagccctgtgaggtgggtgctattagggtccccattctacagatgaggaaactgaagctcaggaagtctcctggctcgccagcaaggcagctggaggttgctgacctccgagggaggccccagccaaggtgggtgctgagtgggcgccccctcctctcccctctcaggcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagnaaa

SEQ ID NO: 338341 - DNA, 3221 bp, Homo sapiens
  misc_feature (3218)..(3218): n is a, c, g, or t
ggggggctgtgctccaggcagggggcaaacacatgtgaaggccctgaggtgggattatacctggggtgttcaggagtagcaaggaggccagtgtggagcagaatgagtgggaaagaagcatgagtggagcttctagatgcagcaggagctggaccaaggaagagttgggctgggattcagttcgaagcctgcagggaaagccactggagagttttaaaccaggggttatcagatttgcactttgagatccgttcaactgccatgtggagaacagactgtagggggagccagagggcagcagggagatcagcgaagaggctggaatgggtgtcccagcaagagatgctggagggtggaccaatgaggttgccgtggtgacgagaggggacatggctagaggggatgttttagagacagaaatgacagactttctggaggaccttgaatgccaaactgggagttggacttgatctgggtgtggggagccttggaaggttgcagagggagagtggggatggggcctcagggcacctccctacgctggcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagtgcgttccagacaacagaggagcaggactggagcagatggagagggcgttagagggggtggcactgccagggcaaagctgtggaggtgggaaagagcaagaaaagttccagagacagtgagggaaccagcttggattgcagagttcagctgagatgttatctcccccagagattcttaccagatggccaagcccaaagaatattctgaatcccccagagggtttcttaaaatgcagtttccagggccccatcctagacctaataactcagcctcacagagccgggggttggagggcagggaagctgcatcaacgtgatgcgatgtgacaaggctctggaccacagggtgattcagccccgtatcagcgctcaggaattctcaggccagtggggagcgggggcgggggcggggacaaacagggaagcgcacagtaagggagaatgtggggactcagagcaggagcctttggagtcagagaagttttccagaaggaacatctaagcagagcccggctaggcaaagtgaactgccatggcgagggcctggagacttccagaagcgtgataactgctcttaattgttcaaccctcaccaggagctaagccctgtgaggtgggtgctattagggtccccattctacagatgaggaaactgaagctcaggaagtctcctggctcgccagcaaggcagctggaggttgctgacctccgagggaggccccagccaaggtgggtgctgagtgggcgccccctcctctcccctctcaggcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagnaaa

SEQ ID NO: 338342 - DNA, 5392 bp, Homo sapiens
  misc_feature (5115)..(5115): n is a, c, g, or t
gtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagtgcgttccagacaacagaggagcaggactggagcagatggagagggcgttagagggggtggcactgccagggcaaagctgtggaggtgggaaagagcaagaaaagttccagagacagtgagggaaccagcttggattgcagagttcagctgagatgttatctcccccagagattcttaccagatggccaagcccaaagaatattctgaatcccccagagggtttcttaaaatgcagtttccagggccccatcctagacctaataactcagcctcacagagccgggggttggagggcagggaagctgcatcaacgtgatgcgatgtgacaaggctctggaccacagggtgattcagccccgtatcagcgctcaggaattctcaggccagtggggagcgggggcgggggcggggacaaacagggaagcgcacagtaagggagaatgtggggactcagagcaggagcctttggagtcagagaagttttccagaaggaacatctaagcagagcccggctaggcaaagtgaactgccatggcgagggcctggagacttccagaagcgtgataactgctcttaattgttcaaccctcaccaggagctaagccctgtgaggtgggtgctattagggtccccattctacagatgaggaaactgaagctcaggaagtctcctggctcgccagcaaggcagctggaggttgctgacctccgagggaggccccagccaaggtgggtgctgagtgggcgccccctcctctcccctctcaggcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagnaaaaaaaaaaaaaaaaaaacaagaacagaaaggaaagaaaaaagaaggggggggggggggaaaaaagaatcccccggggagcggcccagtgtatgcggctgcccccgcttttgtgtgaaacgaagcggggcccataagagagagcgccgataaaagaacgacagacacgggcccgggattacaacagcgcggcgcgggggacaacacgggctacgcgggggaccccttccgcgagcgaccaacactccgggggggacacaagtgcggcacacaccgg

SEQ ID NO: 338343 - DNA, 2125 bp, Homo sapiens
gtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggttccaggggattcaagcaggaggtggtagggagggagctgggggccccagagcatcttcagctgctgttgggtggaggggaggcagggaatgccctggaggcctaggttctagaccaagcctccttgggcctcagtttcctcatctttcccatgggagaattggaatagatgaaagcaatttgttggtatccatccaccca

SEQ ID NO: 338344 - DNA, 5118 bp, Homo sapiens
  misc_feature (5115)..(5115): n is a, c, g, or t
gtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagtgcgttccagacaacagaggagcaggactggagcagatggagagggcgttagagggggtggcactgccagggcaaagctgtggaggtgggaaagagcaagaaaagttccagagacagtgagggaaccagcttggattgcagagttcagctgagatgttatctcccccagagattcttaccagatggccaagcccaaagaatattctgaatcccccagagggtttcttaaaatgcagtttccagggccccatcctagacctaataactcagcctcacagagccgggggttggagggcagggaagctgcatcaacgtgatgcgatgtgacaaggctctggaccacagggtgattcagccccgtatcagcgctcaggaattctcaggccagtggggagcgggggcgggggcggggacaaacagggaagcgcacagtaagggagaatgtggggactcagagcaggagcctttggagtcagagaagttttccagaaggaacatctaagcagagcccggctaggcaaagtgaactgccatggcgagggcctggagacttccagaagcgtgataactgctcttaattgttcaaccctcaccaggagctaagccctgtgaggtgggtgctattagggtccccattctacagatgaggaaactgaagctcaggaagtctcctggctcgccagcaaggcagctggaggttgctgacctccgagggaggccccagccaaggtgggtgctgagtgggcgccccctcctctcccctctcaggcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagnaaa

SEQ ID NO: 338345 - DNA, 2063 bp, Homo sapiens
gtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggatcatctttcctctttggctctgggccattcccatcaggatgagaacacgctgcaatattgcccagcttgaaatgagctattctaggcccccgtgttcccaccctcacccttttacattaaaactccacaaagcagttg

SEQ ID NO: 338346 - DNA, 447 bp, Homo sapiens
tgtactacatcctgggtgagagaatgagactcaaaaaattaagtaacttcttacctaaatctaaatttgtcatattttacaaaatctagaaacaacctcagaataataacaactctattcccagaaagagcttcccaaccccacttttgtgccaatcccaactgcatctgcctgtggatttcgaggttttcagggctccgtggcttctctaagtataaatgctctgtccatggctattgtgagcaggccagaacatctgcaggggaggctcctcaggcagaactggctgctccttcaatgatctcactttacaggcaaagctgtccttagcttgcagtcactgagttcaggcttctacttaccagtcagggttactcacttagttttaaataagaaaatgaccaatgtaaggccaggtgcggtggttcaatgcctgtaatcccagca

SEQ ID NO: 338347 - DNA, 267 bp, Homo sapiens
tattcagatttggagattaggactcttgtttagaacctatatttcccctatatttaaatttaaagtggcttcctctaagaattcagagttccattgtatgcaattaaaaagatagctactgagcaattaaaaaaatacacagcacataagttctgccatagaaggagataacctaatgagagttaggaaacatggcacggtaagctggcctttcttgtttttacctctagaagtgactcagtctttttttttttttttttttttttt

SEQ ID NO: 338348 - DNA, 195 bp, Homo sapiens
acaggagacaatcttggtgaccttgggtttggtgatgaggtttttgatacaacacacccaaaaacacaatctatgaagtaaaacaattgatcagttggactttattaaaattcagaacttatgctccacaaaacacacttttttatttgtagatatgcatggggtagaaatgcaattttgctacattgatatact

SEQ ID NO: 338349 - DNA, 302 bp, Homo sapiens
ctctcccctttccctatgtttccccgctttctacttaactttttagacatgcacatagaactgtttactttccccccaccagacagtcccttcgggcgagttcatctaactatgtgctccacgagggatctctccttgagacttgacagttgatttgcagacaaaagtatgccctcatggaactctcacctccaggggttccccttagacctcacatccattaggaggggatgtggaaaggatgcccacgtggccacttttacaactgctgtcctgctcatttccttccctactttataaaa

SEQ ID NO: 338350 - DNA, 642 bp, Homo sapiens
aggtgacttagaggaccccggcactgctcggatggattggtgaatggatgaacagcggggtggatggatgggtaggtagaagggtggatggattgctggctgtgtggtttactggctaggtgggtgggtaaattggtatatggttaggtggaagggtggatgtatggataggtgggtggatgcttgggtgaataaatgaaatggcaactgaaaggacaggtggaaggatgtgtgggtaactagatgggagggtgaatagaataatgctgacataagcattaacaattatgtctagcctcttgcccctctcttcccaactgccttttccagtggaaaaattgaaaatcatggacccggggaacacattcccctgtggtctgttaatagaggcccagcaaggccagccgaggctgtcaactcacctccccactaggaccctgtcattagccacactcccccaaccctgcccttgggtggaagtatgatctggtgggcactgaggggctgggcccatccaggccccttattaagccttattaagcccacagacggggagcaaaaaggggagaagaactttctcccaaaggtcagctgttggaaaaagaaggtacagatgtctctggggtggtcgtctactctcag

SEQ ID NO: 338351 - DNA, 717 bp, Homo sapiens
agaaacaggaagacatacaatctaagaaatagag[206 bp omitted]caaagcaaatcaaaacaaacacaaaaacaaaaagccaaacaggaaaagaaagacctgtcagctttgtagactgacttatcttttctctccttgccgtctccacacaatataattatattactgttttcacattttctaccatttatctcagttttctctttttcagctacagagagtatcccttacattct[286 bp omitted]

SEQ ID NO: 338352 - DNA, 377 bp, Homo sapiens
gctggtgtgaggagtcaggaacttgaggcatgcaaagtacttgtaatggtttccagtacacaggaagtgcttaatagatgttaactaaatgagatgatgtgtacaaagcccagatgctcagcctgtgagctgcaatggtggtgctgggggtataggggacttgaagctacttgtgtcatgtcctcttgcattccccattggattcagaggttggggccagatcctggggtgcctcagatgccaggttaaaggtttggaccctaatccagtggccttggagaaggccagggatactttagcctgggggtggttgcagtgatccttacgtgataaaatgcttgttaaatctaccagctctgtgcttcctccctcggaga

SEQ ID NO: 338353 - DNA, 353 bp, Homo sapiens
agtgattcaaacccatgttgctcaagggccaactgtaatatgaggcaaggggctgactcacaatgaatgggacagggtcatcaggaaggcctcttgaagaaggcactgtttaaatgatgctcagtctccctggattttccttgttacccggtccctgtactcttttacactgtttccatcacctagaacaaatccgccagctaaaggttcaaagcaacatttccaaaatgcttccctggatcacgtaaaatgtatggaactgtcttttcccacctttcagagaaaagcatctcaatttccaaagtaacaaagtgagctcctctctcacatccggtttttaatttcctttcatc

SEQ ID NO: 338354 - DNA, 126 bp, Homo sapiens
tattaaagtcggaacaaggatcctaggaaaggaatttttttttttctagatctgtctgtagtccctccgaaagtggtatgaaacacaccaccaacaggtgcttttcatcttcaaagaacgtgtcat

SEQ ID NO: 338355 - DNA, 448 bp, Homo sapiens
tccttctcaggtgttggcacatggagcccacagagctaacagccaccccactcctgagtttggatctgcttcagtgtctgggaggtggaggtgaaagacacctgcttttattatggacagagctgattgggtggcgtggtcccatgagttttcaaggtcatcatccagactcgagcaggtttgccctttagttgagggcaggggggactactgcaggggacgccggtggccccagcacgttgcccaaagtgtgcctggtctgcggtctgcaggacagttctcagctctcacagaacatcacggccagctgggggccagggtctgcccttgactctgttccacttcgcccaaggtggggccgggactttggcacttagggaaccccagatggctgtgagggctgaggaccactggactaaatgggatggtgctgaaaagcagttatgca

SEQ ID NO: 338356 - DNA, 154 bp, Homo sapiens
ctcaatagataaaaagcatttgttaaaattcagcatcctttcatgataaaaaccttcagcaaactaggcacagaagaaacatacctcataataataaaataataaaagccatatatgaggccgagtgcggtgcctcatgcctgtaatctcagca

SEQ ID NO: 338357 - DNA, 522 bp, Homo sapiens
ctctggattgagtgtcgtcaggaagcaaaggtacgagtactatgacgtggaatcttaataatgttttgctagaaggcaggaaatctagagtagagatatacctataattggtaaagacagcttgtgactcatatcagccagcctaagggtatgtttggtccttttgaggtttagacatgttcttggtttagtttgtgctcagacatgattggggaatagacttgcttttgtcttgttccattgtggtcttacagcagtcttgtccaatgctgttattctgtgaaaacatgtatgttccacagaacaccaagtcctggcagtgactgacaggccagctcctggttttctctttcttacagtttagtgacattaaaaaacaaaatttcaacaaatttagtttaaagatgtggccaggcgcagtggttcatgcctgtaatcctagcacttgggaggtcacggcaggcagatcacttgagaacaggagtttgagaccagcctggccaacatagtgagacccgtctc

SEQ ID NO: 338358 - DNA, 129 bp, Homo sapiens
ttttgttcctctatatctcctttagtgtttcttttgattaatattttctagtataacattatatctccttcaattatttctttactatatttcccaagttactttcttttttttttttttttttttttt

SEQ ID NO: 338359 - DNA, 1035 bp, Homo sapiens
gtgctttgaaattgcaaaggcttattgtgcagatggcggtgaggaggagatctcggctaccccacatgaaagaccagcgcagtggaggatacctctctccacacccacacacacgctcctgctcagcctgcagttgctcattctctagagaatcctccccagggagttcacacctgcctttgcaagatgcttccatgcacggattgatggccccaggactcctggtaagatgatatgtggcaataactgtcacccagagccaccaaagcacttcacctgccctgccttgtagcctgccctgccttgtagcgcttctgccgggtgtcactgctatttgtatgttaattagactgggggttccccgagagtggcttgtatctccgtgacccctgtgtctctgccggggccctgcacagtatctgctacaccggagcagcaaaataaatggggctggttgaaggagtaagctaaggccagctaactgctctcaagcgcctttaattatggtctttggtgccctcttaccgcttcatcttatttatcactcttttcctgagaccttctaatatagaatgcagacacgaacatgtgtgcatgcacacacacgcacgctggcttaatatatgcacagtggaagctgaatacaacatctcgctgggacacttccacacttgttaagacagttcccaaaacacattaaaaaatgatggattgtgccgtcccggctccttgttcattttagcacgatagaatttcttgatagtgtctgatttcagagcacacctgtagacctagtgacagcctgcgctcctgggtgggtttggaaaagcgcttatttgttctgaagctaaaattaaactgcaagtttttacatgttgtttagcggcagcagctgatgcaaatctttgtcaacacggaacttttcacacctcaggtttcaactacagtaagtggattactatgtaagactggcattgggttttggcactgaaaatgaatgaagtagcttggagaaattaaaagtcatgctcttta

SEQ ID NO: 338360 - DNA, 303 bp, Homo sapiens
atttataagctactgtgagactaaaattcaaaaatggctgttctgtatttattagtttccacatagtttggggccagttgtcttctctttctgaacacttctcttgataacagtaacagatcacacaggaaatatgagagattgtttatgaatgccctgagacccaaaatgcttagacataaactaagattaatttattgcactaaagaagtaattacaagcagagtaattaagattcacaattgtcttgggatttacaacacagaatattccttaatagaacactctggatctataacaacc

SEQ ID NO: 338361 - DNA, 928 bp, Homo sapiens
gtacttatatgatagtgcaactgaacacttaggaatagaaagataatttgatagaatgataatagaactttatagagaccattctcacttcctacgtggaggcctttgtttccgagttgctgtctgtctaacgcttgctgacttgcgttgtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 338362 - DNA, 4154 bp, Homo sapiens
  misc_feature (1)..(1): n is a, c, g, or t
nttttttacaaaaaattatgtttgttacctgttctggaattcccgggatcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacagggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 338363 - DNA, 3547 bp, Homo sapiens
tcttctgccaatttattttttattaattctatttgttggtgattttttaaaatctgttcagaaaattaaaaattttccgtggaatcataaaatcgtgtttagattataaaatcctttatgatttgactgttgccgtcttgaaagtcttcaacatctcaatgttatgaatatctgcacttacattttcttctaagtttttgttaacatttcaatatttaatccacaaaagattcacttacatgtattttttccccaaatgggtaatcagctcttcaaacattatttactggacaggccatccttcccctactaacgtaaatgtcatcttttcatattaaatttctccatgcgctgggtatttactcctacatcttccatctagtgcttttgagaattttcaacactcttccattacacgcatgtaccatcatttatttaatcaatcttctattggtaggcatttgggacgtttcctgctcttccatactaaacaatgcatagaattttggactacattaaataattctctgcctcagtggttcaagttgcgtaaattatgcgtttacacttttcttcggattacttttaaaatgacaaccactatgttttgctggtctcaattaccagagaattggcaagaaacctgacagctggggcttaggattccctgcgccagacctccgagctacaccagagggcgtactttccttactcggcctcggccacatccgggttccaccgcagattcgggcagggagcgggcggaacctttctaccgcgtctctagctaacacgcacggcggggacagtttaggcctccgcgcaccgttcgccgggagtcttgcagtttgcttggtgcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacagggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 338364 - DNA, 421 bp, Homo sapiens
ccatatataaaattggccttgtatatatgctctacactggatcaaagtaattcaaggtagagtcaaagtgaagttggtcagaaagtaattgtcactcattcacacacagaacttccatcataatctcaaagtcaaagaaaaatttatagtgtttttaaatgttcactgaagtggcagcagggcaggaaaggaattgtctttttaaagtacttattagaaaggaccttgtgattgttgttgatcagttgacccttattgattaatgatcattgctattattgcatgttactagcttgaaactaagtggggatgcagtttaaccaacttgtatttactcatagctctacccatgagaaaaaaagcagaaccaatatggctgtgaaacaaggacgattttatttgaggcataatactttgtcag

SEQ ID NO: 338365 - DNA, 357 bp, Homo sapiens
ccaatatggctgtgaaacaaggacgattttatttgaggcataatactttgtcagaagatatacccattgtcatcatatttaaggtaaagctgcagctctcttctgaaaattgtaagaattctttctctggtttatttacatatgtaattagagatttggagggtaaggaattcttggaatagaaagatttgtgatgtaagttgtcagtcatatgatgtattttaaattgaaagctggctgggcgtggtgggtcatgcctgaaatcccaacactttgggaggccaagatgggcagatcgcctgagcccaggagtttgagaccagcttgtgcaacatggtgaaaccccatctctaccaa

SEQ ID NO: 338366 - DNA, 560 bp, Homo sapiens
agctctggcagcagctactggaggatccaggtttcccccacagtctattctgcttagtttttctgcttttaaataatagaatactgagactctttgaaaatacttaaagacattgtttcctgatttgaaaactctgctgtcctaataataatgatagtgatggtaatagtaatggtgttttctgtgattatatattaatatgttattacatcatatgatattatgcaattatatattcatttaaccataacaaccatcaatattacatcttttctcaattgaggctctttgggataggtgtgcttatgcacttttacaaatgaggctaagcagcgtgtccaaggtccctgtccagttattgatttggatccagatgagccctgctccaaagcctcgtgctctctgccagcatgtgatgctacctctttgtttgtttaacagaataataacacatttgtctaataacttgtttcaaaggcaacccactgaaggacggtctcgtgatggtggcttgcgtctcggggaaatggaacgtgactgtttaatcggttatggagcca

SEQ ID NO: 338367 - DNA, 537 bp, Homo sapiens
ctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 338368 - DNA, 950 bp, Homo sapiens
ttcctcttttcttttgcttccttggatgtttctttttttctgggcacatacgtacttatatgatagtgcaactgaacacttaggaatagaaagataatttgatagaatgataatagaactttatagagaccattctcacttcctacgtggaggcctttgtttccgagttgctgtctgtctaacgcttgctgacttgcgttgtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgc

SEQ ID NO: 338369 - DNA, 4963 bp, Homo sapiens
tcttctgccaatttattttttattaattctatttgttggtgattttttaaaatctgttcagaaaattaaaaattttccgtggaatcataaaatcgtgtttagattataaaatcctttatgatttgactgttgccgtcttgaaagtcttcaacatctcaatgttatgaatatctgcacttacattttcttctaagtttttgttaacatttcaatatttaatccacaaaagattcacttacatgtattttttccccaaatgggtaatcagctcttcaaacattatttactggacaggccatccttcccctactaacgtaaatgtcatcttttcatattaaatttctccatgcgctgggtatttactcctacatcttccatctagtgcttttgagaattttcaacactcttccattacacgcatgtaccatcatttatttaatcaatcttctattggtaggcatttgggacgtttcctgctcttccatactaaacaatgcatagaattttggactacattaaataattctctgcctcagtggttcaagttgcgtaaattatgcgtttacacttttcttcggattacttttaaaatgacaaccactatgttttgctggtctcaattaccagagaattggcaagaaacctgacagctggggcttaggattccctgcgccagacctccgagctacaccagagggcgtactttccttactcggcctcggccacatccgggttccaccgcagattcgggcagggagcgggcggaacctttctaccgcgtctctagctaacacgcacggcggggacagtttaggcctccgcgcaccgttcgccgggagtcttgcagtttgcttggtgcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacagggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 338370 - DNA, 4840 bp, Homo sapiens
  misc_feature (4829)..(4829): n is a, c, g, or t
tcttctgccaatttattttttattaattctatttgttggtgattttttaaaatctgttcagaaaattaaaaattttccgtggaatcataaaatcgtgtttagattataaaatcctttatgatttgactgttgccgtcttgaaagtcttcaacatctcaatgttatgaatatctgcacttacattttcttctaagtttttgttaacatttcaatatttaatccacaaaagattcacttacatgtattttttccccaaatgggtaatcagctcttcaaacattatttactggacaggccatccttcccctactaacgtaaatgtcatcttttcatattaaatttctccatgcgctgggtatttactcctacatcttccatctagtgcttttgagaattttcaacactcttccattacacgcatgtaccatcatttatttaatcaatcttctattggtaggcatttgggacgtttcctgctcttccatactaaacaatgcatagaattttggactacattaaataattctctgcctcagtggttcaagttgcgtaaattatgcgtttacacttttcttcggattacttttaaaatgacaaccactatgttttgctggtctcaattaccagagaattggcaagaaacctgacagctggggcttaggattccctgcgccagacctccgagctacaccagagggcgtactttccttactcggcctcggccacatccgggttccaccgcagattcgggcagggagcgggcggaacctttctaccgcgtctctagctaacacgcacggcggggacagtttaggcctccgcgcaccgttcgccgggagtcttgcagtttgcttggtgcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacagggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacatagttcagcgtctgacgggtnccgagctcgaa

SEQ ID NO: 338371 - DNA, 409 bp, Homo sapiens
  misc_feature (395)..(395): n is a, c, g, or t
accctatctaaaacaaactggcatttgggaacaacatattcttggcaatggaacctggacagcattgatcaaacatggtagggaaagttctcattctgcattataaaaaggactgccagatatcaactgttagagatacgaaataagatggaacatttttaactggtttattttcttaaagagacttcctgccctgccagagatcttgaatagccccctagtcagtcatccagaagccattcacataattgattttcttggcttccactctgaaaagagaaccaccttttgcgatactccgccgcgcggggagtatcgcgatactccgggtatggctcagcgctagcgctgagcaatattccatctcaaaaaatactatttataataataatttnagttaagcgatact

SEQ ID NO: 338372 - DNA, 552 bp, Homo sapiens
gatgaatattctggaattaacggtgatggttgcacaactttgtgactatactaaaaacactaaattgtatagtttcagagagaaattttatagtgtgtaaactacatctcaattaaaaaaaaaaaaagtaaaaagaaaacgctgcataagcctcccgtggggttaaaataagagtaagagaaaaaaacatgacttcattgtgtgggtgcctgtgttgaagatgatttagtagcttctgccgtgaggcatttgctagaataaaatcctttctgccctcatcattgtcagcacactggttcgggcctttagcactcctacctggatcgtggaactaaagaattttagcagctgacaaggaccttaaagattgtagcctaactctctcgcttgtcaggggaggcagctggtgccaggcagaagaagtggcatgtttggagtggcctgcctggtgtctgagccacacctgacacccagtgttctttccactgggcctttattgcaattgttttcctctctctttagtctcttcctgctccagtaggattgtacatt

SEQ ID NO: 338373 - DNA, 356 bp, Homo sapiens
gctgggttggtgtccttgactggtgaattgggactgatgagttgggacatgagcagtcactgtcatgtggcaatgattttacgtcagcagcccggcatatctggtagcagcaggagggaaaaataaaatacctcctctgattgaaactgttagagaattcatggaagaggagcacaagtgcccaaattgggaggagacagggattgtcaattgaaatccctgctcttgtggggagaaaaatctttctgatgagtgcgaggaactggggccttgtttcactcttttatagctcatcttagaaatgataccctttcttgcctataaaaaaaactgtttgaggcttaattcagaatgac

SEQ ID NO: 338374 - DNA, 125 bp, Homo sapiens
catgagaaaaaggctgattcctaggtattttgtctttctaggttttgctattgcttttattttaagtttaaccaactgggtgatttcataataccatctattgatgtaagacataaaggaacaaa

SEQ ID NO: 338375 - DNA, 373 bp, Homo sapiens
cagttcagtcctgccctcaaggagttcacacaactataaaaagaaaggtgccaaatgtcacaagacagaaaaatgacaaattactatggaaatgagttatgaagagggagaaattactacctgcaccaggcatgaagccttgtggaaaagagggtgttaggagtgggccttggaaaatgggtagtacaagacatgtagaaactgtgggtagtaaaaccatgtgatcaaaggaccagaggccaccattgaagcactggtgggttggataggtaggaggccagtgaggcttttgagtaaaattgtgatatgattagagctgattcaaccccttgataagtacaaaagttgtagtctataattagcatttaagctg

SEQ ID NO: 338376 - DNA, 304 bp, Homo sapiens
tgcagtggtgcgatctcggctcactgcaagctctgcctgccgggttcacgccattctcctgcctcagcctcccgagtagctgggactacaaggcacccgccaccacgcccagctaattttttgtatttttagtagagatggggtttcactgtgttagccaagatggtctccatctcctgacctcgtgatctgcccgcctcggcttcccaaagtgctgggattacaggtgtgagccactgtgcctggccgcatttaaacattttttaaattgacacataatgtacatatttatgggggcagtgtg

SEQ ID NO: 338377 - DNA, 347 bp, Homo sapiens
ggtctgtagtgatattctccatttcatttctgatactgggaatttacgtactcttttttatggttagcctaagtagagggttgtcaatttcattcatcttttcaaagaacgagattttcctcttgattttatctactgtttttctgttttcaatatcactgatttctgttcatatctttgtttttttccttctgcttgctttgggtttattttgctttattttttctaggttcctgagatgagagcctagattattgacctgagacttttcctcttttctaacataaacatttattactttaaattttcctggctgggcacagtggttcatgcctataatcctagca

SEQ ID NO: 338378 - DNA, 359 bp, Homo sapiens
tgacgtactgaacacagtgcctcagaatgtgatcttatctagagataaggttttcaaagaggtaatcaagttaaaagtaaggccattaaggtgggtcctaacccagtatgactggtgtttttataagaagaggagacaaagaggtagacagacacagaggggagtgaccatgtgacgaacgaggcagagattggagggatgcttctacaagtcaaggagcaccaaggactgccggcaagcagacactgaaggggcctgaacagagtcttccccagggggaagaacccaccatgctgtgatctcagacttctggcctccagagccccgagagaataactgtgtgttgtgcaagccactca

SEQ ID NO: 338379 - DNA, 629 bp, Homo sapiens
ctgttgtgatggagaacatcataaagctcctccaccaacatggaatccatagagaatattcttacctagatacaaaaagttcagtattctatcatgactttaatataagggaaaaataaaaggaaggtgatttacaataaaagaatgcacacttgaaatgttcgggcatgactacacaagaagatataatgacacagccaaatgtttgcacctatgtgtaataaatcaacttgaatttaggagaagtaagatgattcagaaatgcatttctttttttccagtgtctcttctacagaatattttctgaatcataatcattgcagattaaaaatcccacaaaaaatgttcatacaaggagtcaggctcttggctcagaaaattctgaagaagtttctcgcctccatgaatgcttaaagagtcaaatacaaaatgagataatcctttgttgggggaactgttcacgtttcagaacttttggcatcctttgctccacctgcagagagccaacaaaatccttcactaattttaggaaccaaaaaacaaatttccccacttctcagtacagccttcgatactggtctgtcatttctgcctgaccttgtttcttctcccaacacatctatccattt

SEQ ID NO: 338380 - DNA, 629 bp, Homo sapiens
gaaggctggatggcatctgcatttgagggccagagctacgtcttccacactggctacaacttcccacagtgcccagcatcatgcaggacatacagtgcctcctctttacatctctgttaggtgattagtgaacagattaaccccagaggatatatggcattgagatgactttggagaggaagtgagctttgagttgggcctaaaggatagagagcgtctggcatgaggagcaaaagtgaaaggataatccttcattgagaagcatgatgagaacattctagtgacagaaataggacacctccccacctggagtcaagaacatggttgggaaaaggaaaaaatatataatctatatggtgggtccatggaggatctaggatttatccacttaagctggatttgatctgatagacactaggaagctggggaaagctgggagcagggaagtgatgtacatgttaagtggggtgagaatattttagtgactctgtttctttacacagctcatttaaatccctgaatatgtgctaagtatttttgtccatttttctcatagaaaagttttaacttcttaaattttaagaaatgtgaattatcttttgccctccgtaggtgtgagtagccatttt

SEQ ID NO: 338381 - DNA, 322 bp, Homo sapiens
ggtcgactactactactaaattcgcggccgcgtcgacgaaaacacacctgccccaggtgctcatatgctagtggggagagcagatattacatgagatgcctgtagaagatgcatcatacagcagaagcaaaagtgctgtggagcaaagcaaagcaagggcggggtggggcagggacaggatccctgcaaaggtgacctctgaggttagggagggggcgtgcagggaagagcgcctcgggcagggtggggggcagtgcagcaagcaggcaggtgtggcatgagtgtgcgtggggaggtcagagaggaagcaggatgggaagga

SEQ ID NO: 338382 - DNA, 697 bp, Homo sapiens
aaccaattgaaaaactagatatgaaagtagacaagaagttaaggaagactgatttgtttagtttgggtaacaaggatgggtggaaatgtgattgagttatggaatacaggaagaagatcgggttgtagtgggaggagagatcaacagttcagctacagacaaggagagtttcatgtgactctagggagatgttgggtatttgtagatcagatagatttgggtatttgtagagcaggagaagagtggggtttacagttagacttggaaatcttgagtgtttaggtgatagttgacacttcagagtggacgagaacaccaggaagacaagtagaggaagaagaaaggaaggccaaaaatagagctctgaggaacactgacgtgaaagaaacagatgaggtggcacaagtagaggaaactgagaaatagccattagaggtagggaaagaaccagaagagtgttgtttcagtatgcaagggaagaatggacttcaggaagctaaggttcaagggatgcagccatattgagtgagatgaagactgggaagaaaagtttccgaattgggcggcagctatacagcatgggtgtctttagtgagagcaatttcagaaaagtagcaagacagaaaaattgcagagttgaaaaaatgaatgataaatgaacatatggatagtgtgtgaggccagttctttcataatt

SEQ ID NO: 338383 - DNA, 698 bp, Homo sapiens
tttttgacccttaaagcttttagcattttgattgtaagaatatagcatattttaggtgcatttatcttattttctttactgtgtagttgataacatttttatacggatttctttaaacctcataggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttca

SEQ ID NO: 338384 - DNA, 615 bp, Homo sapiens
gttttcaaggcctccacaaagataccttgtaaaacaatttgaaattatttctggacacaataaacctaatttatttattgagatttagactattttgtagtatatgtattaaaattagtcatgttgtgaaacaatttggttaaattttagctataaaactgtgtataaatcaaagcaggttgattttatttttacatagtggttatattatctgtctattttagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttca

SEQ ID NO: 338385 - DNA, 700 bp, Homo sapiens
aaaagaaagggtgagcgcggctggaagcgcgcatgcgctgtggctaatgccgtaggctctttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagagtaagttttttcttttttggggtttttggggggtgcctaaattatactcatctgagtgttaaaatatatatctaaagattaatgcagcagtttgattttcttcaaattaggcttccgaagatgagtcaacagttatatatatatgtatatatatatatatatatatatatatatatatattataaatgttttagaaagcaatagttattaacatgtgctttagaattttaaacaggtctaagtatgacaaaccattaccactttctacctttgtgactttgggtgaaatactttaagcctccaaggtattgtgggatctaaataagatgctatgttaaaagtgcttagccaagtgcttgggccaaaatcagcactcggc

SEQ ID NO: 338386 - DNA, 647 bp, Homo sapiens
aaaagaaagggtgagcgcggctggaagcgcgcatgcgctgtggctaatgccgtaggctctttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagagtaagttttttcttttttggggtttttggggggtgcctaaattatactcatctgagtgcttccgaagatgagtcaacagttatatatatatgtatatatatatatatatatatatatatatatatattataaatgttttagaaagcaatagttattaacatgtgctttagaattttaaacaggtctaagtatgacaaaccattaccactttctacctttgtgactttgggtgaaatactttaagcctccaaggtattgtgggatctaaataagatgctatgttaaaagtgcttagccaagtgcttgggccaaaatcagcactcggc

SEQ ID NO: 338387 - DNA, 206 bp, Homo sapiens
gcggccgcctactactactactgctcgaattcaagcttctaacgatgtacggggacatgtccttagaaaatctttctattgaaaaggagactaaattgtaatgtgattcacaatgtaacaatataaaaataagtttttatataattatataaaagtaagatactctgctgctttactattgtataatatagtagttttaaagttca

SEQ ID NO: 338388 - DNA, 2538 bp, Homo sapiens
aaaagaaagggtgagcgcggctggaagcgcgcatgcgctgtggctaatgccgtaggctctttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccagatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttcaaaacacacaacccaaaccacaccaaagaaaaagccccctccaaacaaacaacacaccaacacacgggggcgccgcgccctatcacccc

SEQ ID NO: 338389 - DNA, 465 bp, Homo sapiens
tgatagctgactctagaggataaacatacattgactgatgacagagttattggcgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttca

SEQ ID NO: 338390 - DNA, 485 bp, Homo sapiens
gccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttcatttggttgaattttcattttttcctgtcacagagcttctaaaaccatggaatttccttagtgatagggaatatcttttgttgttcataataagccccttttgatcacacctgagtttatgctaatgcgttgacttagggtgaggtctctaaatagcctttaacacctgcagcttgggaggccaaggcagagggatctcttgagtccaggagtttgagaacagcctgggcaacatgatgaaacctcatctctacc

SEQ ID NO: 338391 - DNA, 483 bp, Homo sapiens
gccatcctgcgtgtcttgcgctcggtggaaatgcccagccgagggacgcgaccagaggacagctctgtgctgatccccaccgacaattcgaccccacacaaggaggatctaagcagcaaggtgagtgtgagacgcgacgaaaaggctcctggactcgggaccgggcgccactggaccctgaaggtggtccgcagcgggcagcgtggggcctgcctgggcctcggctttgccctgctactttgctctttttattcatagcacttgacagccacagttagtccttttattttctgaaaacagttgcgaaaagggagatcttgaaatttgtcccgagactggacccaggtgacagtggggcggagttttggttgggtgttttcctccctagtctttttaaacttttggaaataccgcccaccccaaatctgttccatcaaagatattctccatccagttaaccatgccagcaacccggggtccatc

SEQ ID NO: 338392 - DNA, 2450 bp, Homo sapiens
aaaagaaagggtgagcgcggctggaagcgcgcatgcgctgtggctaatgccgtaggctctttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccagatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttca

SEQ ID NO: 338393 - DNA, 2404 bp, Homo sapiens
aaaagaaagggtgagcgcggctggaagcgcgcatgcgctgtggctaatgccgtaggctctttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccagatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttca

SEQ ID NO: 338394 - DNA, 252 bp, Homo sapiens
ggggcctgatgcccatctgggccctgggtgtccacctgcagcatggatgtccactggtactttatatccaccaggggcctaatgtccacctaagacctggtgttcacctggggtctgatgttcagctgaagaccggatgtccacctggagccgaggaatccactcagggactggtgttgaactggggcctgatgaccacccggggacaaggtacacaccaggcttgttgtccacctgtcaccagatgtccac

SEQ ID NO: 338395 - DNA, 350 bp, Homo sapiens
aggctaacaagtaaccaataaggtggtttactcaaaaaggtgtactaagtccaacaaatactcagttaggaatgtttaattgaaaagcagttcaaccgaggcaatgatcagtgaaaggggaagctagtgatttatgatgtaaaggaggcccgatgatccattgtgagtctaatgccagctgatgtcattacagaacagaaactgagggcaagaagaagctatcaggtagaaagtatctcaattataaattagaggtcaaagtggtgatttgagacagaaggaacaagtagcacaaaagaaacagcgttatcttgaagggaaagctgtagagatccagctccttagatctc

SEQ ID NO: 338396 - DNA, 104 bp, Homo sapiens
tacacaattgcttctttatagaattcaccactcctgagttttaactttcccaaggatactggtcttccaaaggaattttaaaaacaaattaaagaaccacacta

SEQ ID NO: 338397 - DNA, 218 bp, Homo sapiens
ccttcccaaactaagcttacatctagatgcagacaaatgcaggttttaaagggaaaacctatatatgtgtggtgagacatgcaaatgaaacagtaaggcttccaacacaacttacatacttataattaattattcatatatggatgagaatatgttcaaataccatgcacgactatttctaacattttccctattttcactatatttgtgcataaaag

SEQ ID NO: 338398 - DNA, 423 bp, Homo sapiens
tcctatttttttccatctcaggaaactaccatatatctaactgctcaggtcaaaagtctaggccattatctttgatgtcactctttcccttattctcccaatgcaatcaattagaaaattcaatcaactctaccctaaaacttgtcccaaatgtatccacttctctccattaattactattatcctagtctaagctaccattatgtcctacctagacttttgcctgtctctacaacatattctccatacagtagcccaggatattttaaaaacacaaagcagatcatgtcactttcctgtctaagccttcaatggctcttcccactgaactcaaaatccaaactccttaccctgacttacaaaggcctatgtggactgattcttgcctatgtctcagatttcatctcctaacactctcctgct

SEQ ID NO: 338399 - DNA, 450 bp, Homo sapiens
tccagtgagcatgatagatgccattgtttcgcaagttttctattttctttgtctgtacaggttgttcctgacttcgtggctgggaggaaattgaggatgctgaagagtacttgccgtttggccggtggggttgagccagtcagctggctcctgttctcccatgggcccctatcggggctgggtcctgtggctgtaggagaggggccacatagaggcaccgttctaagttctgtggggggacagcacagttcctctggtcgccacacatgccctgtctgactcatctattatctagactcataaaaaaaaagatcctaaaaaatactggctccattctggagagttggcgcagaaattcagattgtggactcattctgtaagctggcttctgttcctcacctcccacccttttcgccatggccttccctacctactatcatcaatccccac

SEQ ID NO: 338400 - DNA, 264 bp, Homo sapiens
cctcgcaaaatgcaccatttcttcctctcaatgcctacctacgcctttccccttcaaaacccaactccaatgccatttcctcaaaaaaaggcttttttatcatggctgagtcaataccagcaagcactccccctccccgaactcttccagcaacagctacatataaaaagtccctgacaataaatctgctctccacgacctacattcctacatagctctacagactgctctgcagttgtttaaaattcattattcagccgggcc

SEQ ID NO: 338401 - DNA, 3850 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacaagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagaca

SEQ ID NO: 338402 - DNA, 3624 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatggaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacaagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagaca

SEQ ID NO: 338403 - DNA, 3055 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaaggtaaccactcaggagtagatactcagtgcctttgctgacatgtctgtgttctacaaacaccttctctccattatttttctgtttttaagttcccttagagcctacagtgcagtagtgtagatcaggggtccccaacccccaggtcacggaccatactggtccatggcctgtcaggaactgggctgcacagcaggaggtgagcggcaggtgagcaagcattaccacctgagctccgcccgctgtcacagcagcggcattagattctcataggagcacaaaccctgttgtgaactgcacatgtgagggatctaggttgcaggctcctcaatgcctgaggatctgaggcggaacagtttcatcccaaagccatcctaccacccactaccccgcacttcctgggtccctgcaaaaattgtcttccatgaaaccagtccctggtgccagaaaagttggggactgctggtatagataacagaccattagcattttctcctttatatgaaacatttattatttgatttatttgtgtctattttgctctgtggcttggacccagaaacacttgtataataggtgaaatgaacaaagaatgagctgccagaacatctgagagctgtaaagttaaaattatttggacccaaagaagcatagtctgacgttgttcagttcacacaaaattttgtctgaaaagccaacttttttctttcccttttaaattatgctgaacatttagggccagtatgtgtaactgacatgctgggacagttgtactcacttttgctggcctgtaggactgtgacatagggagaacactaagtgtgtcctccgggcctcgggtctcagtcctggagctatctacagtatgttaccagcgagtaagaataatagcttctacttgcttttccctacagagttcaggagttttaaaacgtcatcttagtctcattatgaccttcacatgggctatgacaataatttcctgtagtcagcagatgtctgaaggaagatattttttaactgaatctttacaccaaaaaaagaaaataaaacggtgcgtatctaggactctagtgagggctgaggacaatagg

SEQ ID NO: 338404 - DNA, 2258 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttctgatcatgtctctgcttttattataataaactgattccatctctaaaaaaaggctttagagcaggaacaaagggaa

SEQ ID NO: 338405 - DNA, 241 bp, Homo sapiens
aatagcaatcatagcatacatttgagcaaatgtatctaagaagtacctagtcctttgtcaagaaaaatggttattgaggccacagttgaataaatatagcattgcctccagacggccaaaatagttttatcttttctccggaagtaagagtttaaaatgccatatttcactgactctgagacatgtttttctcccattgctttactgtttctgaaattgagaatgcctcttaaaatcagtg

SEQ ID NO: 338406 - DNA, 398 bp, Homo sapiens
taacacacagctgttacctattttatttcctataaacagaattcccattccctaagccagacatgatcacccgtttggaaggggaggaggagtctcagaattctgacgagtggcagctccaaggaggcacctctgcaggtactacaagtaaagcagttcagcgtccatccagctgggaacattgtggagtgggattttcagtgtacattccacggggtatttaagaggtagaaggattatgggttttggagttttgaaatctccctctttgcagtgctaaatgtgtgacagtgtgtgacaggcaactgcttttacctcagagcttccattcttcctctatcagctctgagtaacaagacttgatgtatgaccttgtttgtggatgaagcaaaatgagg

SEQ ID NO: 338407 - DNA, 5724 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacaagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaataggctatggtgattttatttctttacctattagcattgtgaaaagttacattcaaggtattggctacaccttattctccatccggtttggtaccaatatattacatctttcagtcaaaaagtgttcatgagatgcagtgtaagtaatattggtatctgtgaagacacagggaagaacgtgtgcagtggggcaagtttgacataaatagcttttttcctcagtcatgttttgtatgctctcagcagtggtacattaccaaaatcacatgaaagaaatcccataaagggatctgaattttaaatgaaagtatgatgaacccgcaagtcttaattatgcacttttaataaaattagtcctgacaatttacagtgcccataaagtagtagttgattctccaggaataatctggcagtgttatttttccttttcaacccatcagcattaaatgctgagccactctccaagtctgacccctagactaagcttccttactcttactcttcctcccagaggcattttggaatgagtcaaaggcatggtaggacacggcatttacctgtggtcatcacttcaggcaatggaaaggaaaagtgtttgtccttggttgatcagagaagtgggtgataagaacgtgctaaataacaaacctgcacacttgtacctctgaacctaaaatgttttttttttaattcagaacaacaaaagaacatgctaagcgagtcctcccacctgcctggtaaaatacagccagctttatcacacctggttttgcacagtgataaattcctgcaggaaaaaataagttttattctaagtctgaaattatatggtttccaacagctttttccctcgttaaaataattatttttctacatgatgcttgataataagcatttgtttcttaacctaattagagaagcgattgcactcgagtccccacagctggcagtggtgttacagatggaaccagcctttggtggacagagttcagatgtttcaggggctcttgtgaaaatgctaagtattactgtttctaccttactgccctgcactttaccccatcatctcccctccttagaaaatgatttcataggaaaattggcatggagagcagatagtagagtgtagacctgaaatacatgaggcaaaggcagtcttccagcattctatggtcccaccaggtgggtaggtgactaggaattcaggccaggtcctagagagtagtgagaagttttccagtttgcagtttcctctgtgctgtatgtacagccatacagcctatggaacctgacattgcagtgggcagcaggacacggtcaaggctcctagctgcctctccatctatggaactatgaaatttcacacatattccctaggcagcattaaggcccaggtatattgagtagtccaaaccaaaaaactatattcgagtatcagtttaaattcttccaagccctaaaaattcttacgtagtttctcacctaaaactaatggcttgtgccaagaactgaaactaagctattgatttttttttaagaagtcttaatctatacataagaaattacatacctggccaggtgcagtagttcaggcctgtaatcctaacaaacactctgggaggccaaggtgggcagactgcttgagctcaggagttcattaccagtctgggcaacatgataaaaccgtgtctttacaaaaaaaaaaaattttaaattagccgggcatggtggtgtgaatctgtagtcccagctacttaggaggttgcgatgggagaatcacctgagcccagaggtccagtctgcagtgagccatgatcacaccacagcactccagctggggtgacagagtgagaccctatctcaaaaagaaaag

SEQ ID NO: 338408 - DNA, 3410 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtccatcaaaagaaacctgtaaatatgaaagaacaaaggttatttcctggagaaaagacaatttattcaacaccaacaagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatatagttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagaca

SEQ ID NO: 338409 - DNA, 3034 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaaggtaaccactcaggagtagatactcagtgcctttgctgacatgtctgtgttctacaaacaccttctctccattatttttctgtttttaagttcccttagagcctacagtgcagtagtgtagatcaggggtccccaacccccaggtcacggaccatactggtccatggcctgtcaggaactgggctgcacagcaggaggtgagcggcaggtgagcaagcattaccacctgagctccgcccgctgtcacagcagcggcattagattctcataggagcacaaaccctgttgtgaactgcacatgtgagggatctaggttgcaggctcctcaatgcctgaggatctgaggcggaacagtttcatcccaaagccatcctaccacccactaccccgcacttcctgggtccctgcaaaaattgtcttccatgaaaccagtccctggtgccagaaaagttggggactgctggtatagataacagaccattagcattttctcctttatatgaaacatttattatttgatttatttgtgtctattttgctctgtggcttggacccagaaacacttgtataataggtgaaatgaacaaagaatgagctgccagaacatctgagagctgtaaagttaaaattatttggacccaaagaagcatagtctgacgttgttcagttcaccaacttttttctttcccttttaaattatgctgaacatttagggccagtatgtgtaactgacatgctgggacagttgtactcacttttgctggcctgtaggactgtgacatagggagaacactaagtgtgtcctccgggcctcgggtctcagtcctggagctatctacagtatgttaccagcgagtaagaataatagcttctacttgcttttccctacagagttcaggagttttaaaacgtcatcttagtctcattatgaccttcacatgggctatgacaataatttcctgtagtcagcagatgtctgaaggaagatattttttaactgaatctttacaccaaaaaaagaaaataaaacggtgcgtatctaggactctagtgagggctgaggacaatagg

SEQ ID NO: 338410 - DNA, 906 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcaggtactacaagtaaagcagttcagcgtccatccagctgggaacattgtggagtgggattttcagtgtacattccacggggtatttaagaggtagaaggattatgggttttggagttttgaaatctccctctttgcagtgctaaatgtgtgacagtgtgtgacaggcaactgcttttacctcagagcttccattcttcctctatcagctctgagtaacaagacttgatgtatgaccttgtttgtggatgaagcaaaatgaggcttgtgcagcatttggtctagtgcaccttctggctgaacagggctccctcagtggcgtaccatgtgcctctgcaaactaagaatagtgagaggaagcacacttcctgagttacctggctccctgtccatctcatactggatagaaaaagcaatagcaatcatagcata

SEQ ID NO: 338411 - DNA, 876 bp, Homo sapiens
ccagtcacaccattccccagggtcccctcacaccccatcagcctggacaggagctagaaacaggtgggggaaggtggagacatcaccagggcctgagcaagatgggctgtgagaaagaggccttagcaagaacagctaaaagcctagcagaaaaatgggcccactgcccaaggtgagtccttggaaagatgccaacacattcaactgtgggtcgggaggatagggactgtcgtattcatcacctgtccttagaaactgagcttatctgggtgctgggagcatggtagacctccacaatgcatgctgaatcaaagcgcaggatcataagcctgctctacccaaggggcccatccaggcctagctctagaaccaggttgtcctctggggtcatggaaaaggaaagtcagtcagagggtccagcatgttgtgagaactaatgaatggcatgcagaattatattctgcatggcaaataaatatgcaattcaatgggctgcacaggcactctatggaatggcggcatggcatgctcgcacacactctcccaaactctggccagccaagaaactatcaccacatgcccttcagctaagccctgggaggagctgtaggcaggggctcagcgggcaggcagacaggcagtgggcaaagcagagcacgcagttagctgtgattacctcttgtgctttggggcagagaagagtggaagcaggtggggttaaagagacagaggaggccccagcctgagaagaccctgggaaaaggcccagagccttagtccccagccccatctctgaggactcggagatgagcagctcggcctacagagaggggacatggtgaggggctgcatccctcacacttggcccagttcccc

SEQ ID NO: 338412 - DNA, 1450 bp, Homo sapiens
ttggtaagcaatccagaaacctgagtttattcagagtaagtgaccaaatcaatgagtaaaagaacttggctcctacatcaaagccaagtctttgggcaatgctggcagtttctcctggaagtaatgagaaatgttgtgaaagaactcagcgcattggccagaaatgattgaaaaaccatcaaatttggggcagcaggaggtgtaaatacaagtgagaaaagggattctagagccacctatgaaataccacaatctccttgaggtggggaacattccttgatgttccaaaactgagaaaagcacacccagggccagtctttgtagagtttgttgctgttaagagcccacccaggcagatcacaaggtcaggagtttgagaccagcctgaccaacatggtgaaaccccatctctactaaaaatacaaaaacttgcccggtatggtggcatgtgcctataatcccagctactcaggaggctgaagcaggagaatcacttgaacccaggaggcagaggttgcagtgggccaagattgcaacactgcactccagcctgggcaagagcgagactccatctcaacaaaaaaagagcacacacatctcaacaaaaaaagaggctactggtgttgagggtagagcttgctgctaatgaaccaagaggcacatccttttccatggagaataggaagccccgagaatggggaggtgtgtgacagccatgctggactcagaggcaggtgtcataaactgccccaggctcctcattctcccttctccctcatggagaacagttgtgttccccttgtattatagatccagatttttgcctttggcctgcttactgtctgtttccttggtgacttggtagtcccttctaggacactggaatgcttttgtgccagcccctcactctcgtcacctaggctggagtgcagtggtacaatcatagcttgctgaagtctccactcctgcaccctcctacctcagcatcctaagtagccaggcacacacaccaccatacccagctagttttttggagaaaagtgtctggctatgttgcccaggctggtcttaattcctgacctcaaggaatgctcctgccacagcctcccaaagtgctgggattgaggcacaagccactgtatctgaaatagaatcctatccctaactcaggaggtccaggtagttagtcttttccacttaaggcagttctccaacctgaggtgacataaaagcactgatctagagacactggcaaaaactaatgtgcaaagaaatgagtcatataggggaaatcaatttctctgggctacaacttccaactccctttactccagtacccagaatcctctcccaggtggtgcttcaagctgctcaggagtgctttagggttcatcgcaaaacaaaagggagtgatgaacacaggctctataaagttcatcagaaggaacag

SEQ ID NO: 338413 - DNA, 265 bp, Homo sapiens
caacattaagttctgaaaatgtactacacattttgctgagttctctatataaataacagtgaatagttaccttctacatgtgtcaagtatttcacatgcattatatctaatcctcacaataatgaaagcaaacccttatgtgatgttttgtgcaaggcattgttctcagcgctttaccttgactaactcttttttttttttttcaatttttttatataatagatacggtttcgccacgttcttcaactcagatgcttctacggta

SEQ ID NO: 338414 - DNA, 378 bp, Homo sapiens
tggggaggcggaggttgcagtgagctgagatagcgccactgcactccagcctgggcgatagagcatgattccgtctcaaaaaaaaaaaagcctcaaatgaggaatatatattgaaagagttttatttatttattttggtttaatgaaaatttgatctgttgtatttttaattagaaattatttgcttcaaggtttttatacaggacatacaggaactaatttggatatttttaatattatagatctgtactgcgttctcagaaggctacaaaactctgtaagagaaaaataattatttggcctgcattgtttaaaaggagatcatatctagttgaggaaaactggtggcgttggagcatggctttgacagattttgat

SEQ ID NO: 338415 - DNA, 928 bp, Homo sapiens
gaaaaggagatgcataggggctatcgaccaagcagggcatgatggttagaactgagctgggttttgtaggattagtagaattggatagagaaaggccaagggaagggcaacagttttctaaatagttcttttatttctatatcattgtttactctctctgaactcagggttgaaatgtgtgtgtcttattcaccactgagtcccccgggtctagaattatgtctgggacatacgagatactcaataaacagtaattgaatacatgaacaaacacttgttgccagaatccttttcctaaaatacagatgacagctggggctaccactcgcaatgtatgcacgcctttatgcaaattagaaaaaggtgtcccattcccctaggttgatgcccttcttctctaggatttgtggctaggagaatcaatctggagttcacctcacccatgaccgaccccaaccctactgcctggccaatcttccttctgaggcccctgcccccaactgcatacagggctggcaatcaaagcccttctcaatctgaccccaactttcctgctccatcagaaccattttcaaccttgattccgtgcttatgctacagtagtcctcagcttcagtgtatgaattcccactactgccttcatcccaccaattcagcaactttacaccaaacacctaccatttaataaagaggagccatccccattctaatattgttctcagcgactctctagaagctccctcttgtcctcacatgctcccactcagactctctttcttcctgtctttgattaagaagatatactagcttttgactctcagctttcccttcatttgggccttggtcccctttggacaattttcctggactttaaaggaaacaggcagcctgcctccttagtcctcctcaggtggaatcaacaagcact

SEQ ID NO: 338416 - DNA, 319 bp, Homo sapiens
tttacaccaaacacctaccatttaataaagaggagccatccccattctaatattgttctcagcgactctctagaagctccctcttgtcctcacatgctcccactcagactctctttcttcctgtctttgattaagaagatatactagcttttgactctcagctttcccttcatttgggccttggtcccctttggacaattttcctggactttaaaggaaacaggcagcctgcctccttagtcctcctcaggtggaatcaacaagcactctttctccgaacttacccagcacattgtaaaacctttataaataaaacctt

SEQ ID NO: 338417 - DNA, 448 bp, Homo sapiens
agtaaacgtaccacttgaaaacttggaatgcttttcagctactctgaaattataatgcacagttagaggctatgaaatgctttgaagaatgccaccagtcctatttataacaggaagcactcccctttatttttagtccttttgattttcaaatttactgttgaagaaggaaaaaaaaaatctgtccagggaacatgatctgggaagcccattaaacctcatttagagttccattttatttctgtaaacagaaagaccagggctcatggctcttctaagttaataagtctaccctgcaataaacaaacctgctttgtcaatttgtgtccttaaattagatttaacttgactttacagtgggctgactggctggtaaggggggcctctgcagagtagccacagggcaaacggcattccagtgggggactgccccaggggcttctggaca

SEQ ID NO: 338418 - DNA, 517 bp, Homo sapiens
gatggatgaaatcacaggtaagcttagagatgatgactattgtgcccagcacaactgtgcttggagggaatctgggctgggctggggttggtagtggagagtgtcaccaactaaagggtagctctgaaaaaggggctgctttaggagcccggtgcctggagtggtgcacagggggctgtgattgcctggaaaccgagcaggactgagaaccaggagagggcagcgtggaggaggagcccctgccaaatgcaagcagccctgggaggctgcgtcagacagcaaaggcaggaggtgacctgcgccacagtccctgccccatcagtgccccacagcggcacttctgcccctagagctcttagatgccagttggtctgtgaaagggagatttggcggtgttagaggccaaaggttctacgctctctgctgaataagaggcgaggtcctccgatcagaacagaaggacccggggtgcacggccttgctgaagagttgtaaagattaacttagtgtttattaa

SEQ ID NO: 338419 - DNA, 363 bp, Homo sapiens
tataaactctgctcaaatccctgaccggcccctaaagtaggcatgaatggggtagactccaagcagcccaggtaaagttaaccaacaaaaaaagaagagagatttcagagtttggagttcagccaaattaattgcctaccaaaaccggatgaaaccaaaccaacactctttggaggaatataacagaatctacagtaatttcaacacaatgtccaggatacatttcaaaattgttagacatacaaagaaagaatatgcgacccatattcaagagaaaagataatagtgactgaccctgatgaccaaaatgttgaattagcagacaatgattttattttatttgagacacagtcttactctgtc

SEQ ID NO: 338420 - DNA, 428 bp, Homo sapiens
ctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccgg

SEQ ID NO: 338421 - DNA, 263 bp, Homo sapiens
tcccagtctttgtgctgctattgtcataaactttacttctatgtaagttacaaatgctacaatgtgtaattacctctaagacatatcttttaatgagactgaaacaaaaagaaaaaatatcttatgtatttatccacttagttaccctttgcattgtcttcatttatttttatagctccagttttcttttatttgtttgtttatttagacagagggtctcactctgtcacccaggctggaatgcagtggtgcgatcatagctc

SEQ ID NO: 338422 - DNA, 352 bp, Homo sapiens
tgagatggagtctcgctctgtcacccaggctggagtgcagtggtgtgatcctggctcactgcaacctccgcgtcccgggttcaagtgcttctcctgcctcagcctcccaagtagctgggactataggcatgcgccaccaagcctggctatttttttgtatttttagtagagacggggtttcaccatgttggccaggctggtctcaaattcctgacctcaagtgatccacccacctcggcctcacaaagtgctgggattacaggcctgagccactgcgcctggccaggagttttttcttgagtgacgtttgctagtataacatagttggggccagtgggtggggtgggaggct

SEQ ID NO: 338423 - DNA, 541 bp, Homo sapiens
gatcaagtacaaacttcatgtagatgtcatgtaggagatatcaagttgtacatatcaagtaaaatggatagatgtgagcctgtgcagttgagaagtgttttgtgtgtatcatcctgcaaatggaaattatgtagaatgcaggaataaataatagagtggtgttcttaactgtcttataccagcactgtgtgctgtaaggactagcagtagtttgtggctgaaccagcccagctgttaggactacctgttgatgccgggcaagggggctcacgcctgtagtcctagcactttgggagccaaggtgggtggattgcttgagcccaggagtttaaaaccagcctgggcaacatagcaaaatcctgactctacaaaaaaatacagaaaattagccgagcatggtggcgtgtgcctgtagtcctagctacttgggaggctgaggtgaaagaatcacctgagccctggaggttgaggctgcagtgaactgtgatcgtaccactgcactcccgcctggacattggagtgagaccctctcaaggggtag

SEQ ID NO: 338424 - DNA, 584 bp, Homo sapiens
ctcaagtgatccgtccacctcagcctcccaaagtctggggatcacaggcatgagcccccatgcctggccaacctagcagtatgcttttatggttcttactttttgtgtgtgtggctgcatagctgatttctttttattgctgaataatattcccttgaatgaatgtaccatggtttggttatccattcacttattgaagagcatcttggttgcttctattttttggcaattatgaataaagctgctataaacatttctgtgtaggcttttgtgtggacctaagttttcagctcatttgcgtaaatacgtaggagagtgattgctagattatgtggtacaagtatgtttagctttgtcagaaactgccaaactgtcttcagacgtggcaggaccattttgcattcccaccagcgtgaatgagtttctgttccacatccttaccagcatttggtgttgtcactgatttagattttagccattctaaggtatcttattgttttaatttgcaattccctaatgacatacaatgtcatcttttcatgtgcttatttgccatctgcatctttattgaggtatccagatct

SEQ ID NO: 338425 - DNA, 209 bp, Homo sapiens
ttgtgagaggtacagtaaatgagaacatgcctgcacataatgtactgagtaaatatcagttagtgtttatgcaatgagggagtcactgccttgcccaaaacttcattgcctcaattcattcaagaaaataacctccttactctggcatttaaagctttccgctattcactccctacctctccagcctttaaactgatgatcctttgcag

SEQ ID NO: 338426 - DNA, 7322 bp, Homo sapiens
  misc_feature (2731)..(2731): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggggacctgcagctgctcgtctaagggtttctccaccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaactaaaaaaattca

SEQ ID NO: 338427 - DNA, 5672 bp, Homo sapiens
  misc_feature (2731)..(2731): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaactaaaaaaattca

SEQ ID NO: 338428 - DNA, 2729 bp, Homo sapiens
gctcgccgagagacagggaggggagtgtggcagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaactaaaaaaattca

SEQ ID NO: 338429 - DNA, 5069 bp, Homo sapiens
  misc_feature (2731)..(2731): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggtaactgcgggcttgggcccaccaagggcttaaaccaagtgctgggtctcttgggttggggaaataggttctgggtcggcagatttagaaactgcagcagtttggctttagtctggactgtttcctgtgttgctcattttgagcgatcagcccagtgtttggttcacacagctccggagaaaaacaagtcacggcacagccttgacttgggactgcgcacatcctgcgttcccaggatgtctcctgtggggccatcggctcacagccgggaaagttcagcccactctgcggcctgtcggtgtctggtccccatacaggagcactgagctgggtcaaaggctcctgagctg

SEQ ID NO: 338430 - DNA, 4872 bp, Homo sapiens
  misc_feature (2731)..(2731): n is a, c, g, or t
  misc_feature (4759)..(4759): n is a, c, g, or t
  misc_feature (4770)..(4770): n is a, c, g, or t
  misc_feature (4783)..(4783): n is a, c, g, or t
  misc_feature (4791)..(4792): n is a, c, g, or t
  misc_feature (4794)..(4794): n is a, c, g, or t
  misc_feature (4813)..(4813): n is a, c, g, or t
  misc_feature (4821)..(4821): n is a, c, g, or t
  misc_feature (4823)..(4823): n is a, c, g, or t
  misc_feature (4838)..(4838): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggtgagccaccaaagggttggccccaggaacgcgattttgnggacgcatcgnaaaatcacagggnggggggtnngncccaatcccaggatggagntttaggantntcccgttgcacaggnaagggcctcggttttgaacacaaattaagcaatt

SEQ ID NO: 338431 - DNA, 3649 bp, Homo sapiens
  misc_feature (2731)..(2731): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcgtaagtgtcagtttac

SEQ ID NO: 338432 - DNA, 286 bp, Homo sapiens
tatatccagacgtattgtaggtggaatggaatgtggaactccatcactctgagttgtctcatttcacacagatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccgggtgagcataactttcttggcttttttgtttgattagtaggatagtagagtatgtgttggtcgagcag

SEQ ID NO: 338433 - DNA, 383 bp, Homo sapiens
tcccagaagtgcatgctttacgaacatatgcttctctccctagggccaccttgagtgaaaccctcccatgctggaattgggccctttcagtgacaacacacaacagttttcaatagataataatcccaagggctttactagcacatgaaacacagggaaaacgtgtaaagttcacaagaaagtcgttccagtgtatcaaatctatcctgtttgccaggtggatataccagggtctcctccacctgtgcatggctggtggtgggtccagtggctgttggataactgatgtattgatggatcattcgccttctgaaagtgccaaactgattagttattttgtgtgtctttttgtgtaactagggtttgaccttccagggcagact

SEQ ID NO: 338434 - DNA, 479 bp, Homo sapiens
acgtgtaaagttcacaagaaagtcgttccagtgtatcaaatctatcctgtttgccagtttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatggaagtgctgtaccacactaggcagtgtgtgtagtgaccacagactggctgagtgtctcccatcccatgctggcccatatctggtacccacctgatccacaaatgttccatcagatcctgttcaaacaacacatctccagttaagccaaatcttgccctttctccttacggtaaaatgtactaaatctgaaggttttgtc

SEQ ID NO: 338435 - DNA, 5231 bp, Homo sapiens
  misc_feature (2731)..(2731): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaactaaaaaaattca

SEQ ID NO: 338436 - DNA, 2607 bp, Homo sapiens
  misc_feature (121)..(121): n is a, c, g, or t
  misc_feature (131)..(131): n is a, c, g, or t
  misc_feature (177)..(177): n is a, c, g, or t
aattagagaatataataaaaagaaaggttgtctagaaatattcacatgaaatagaaaggcaacccgcaaatacccatttaaccttggtccatatggattaagacagtttagtggagtaggnaaccaaaggnccccccgttgggaagcttaagggagatgacgcgttgcgttggggcnttgcgcgagggaggggagggagggggacgggggggagggagggggggggggagggggggaagggggggggggggggggggggggagggaggggaataaggagaggtcaggctgggcgggtgtaaggccttcccaaagcctgactttgtatcttctcctccttctgctcttccctcttcatcgccctctccctgtgtctctggccctgctgcaggctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaactaaaaaaattca

SEQ ID NO: 338437 - DNA, 4981 bp, Homo sapiens
  misc_feature (2731)..(2731): n is a, c, g, or t
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttngcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaatcgatgagctgctcacaggacgagaacatctttacctttatgcccggcttcgaggtgtaccagcagaagaaatcgaaaaggtgaaaaatgttttgttgtggccacataggagtctggttaattacaagcctgtttcatgagagtgcattctcttggagatgagaaactgaagcgtgctattcattcattcattccaacaaatgtttactatgtgtctactgtgtgccaagtactgttctagaaaccaggagtatagcagtgaacaagacagacaaaaaaaaatccccactctcatatctaacaaaatgttgtatgcatttatcctctgactcagcaatcacacgtctaagagtttatcctgaagatgcatctcccacagtgcaaaatgaatatgtataaggtgatccattgcatttgtaattgcaaaatgctggaagttacctaaatgtttagtcattgtagattggctgaataatt

SEQ ID NO: 338438 - DNA, 442 bp, Homo sapiens
agagcttctaagggtgggaacacctctgtgaagttacaccaaaaatctaagagcagcccccagatcattttccctgcagagcactgtctcacagcagcctgggttttatttgtcctgagattgatgtgcttgaacagtcttcaaagggtctgatccgaggaggtgagggttgccctttctgcatttacaaagcctgaacagtattagggctttgaacgctataaacatctaagaggcagcaccaaaccactgctgggttaaggtacccccacaatgccacttgccctgggcctttctcttcctcaccctccacagccccttaactctcccgtccttcttgtgcctccaggtggcatgcagagaaagctgtcggttgccattgcctttgtgggagatgccaaggtggtgattctggacgaacccacctctggggtggaccctt

SEQ ID NO: 338439 - DNA, 437 bp, Homo sapiens
aacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactc

SEQ ID NO: 338440 - DNA, 98 bp, Homo sapiens
gattcaatgcaatccaaaatattgattatggaaaggaagcagctgggaggtggaaagacctggagaagagaggtagggaaaacggagaccatgaaaga

SEQ ID NO: 338441 - DNA, 291 bp, Homo sapiens
tctcacacatttctctattcacattgtccccggcactccaattgtgttactaaaaaagccttctctaatagtaaccatttaaagttattcaaatgttgttaaggcttacctcacatttcttcaagggttgtaatgtagatttaaactctcttttatttggttctccttttctaaaacaacacacaaaaaattcagcttatcttctatctaaatggatgctagttctcccaaggagagataaaatatcctaacttatcctccaatagttctaaactcactgctgaaagaatt

SEQ ID NO: 338442 - DNA, 467 bp, Homo sapiens
agctaacttttaaaaactacaactcattaaaaatatgtatcatttttaaaagtaaaggcaatccttatagcacagacttagtcttccttaccagcgttatggataacacaatactttcattggattttaaacctttcaaccacctgcttcagataagacatgtcttccttcctccatccctccctctctcctccccacttttcctttccttttttttctttccttctttttcttctccttgtgcaaggcccaaggtatggcaatcaaatgccaaacaactaggacaaacatcctgagtggtctaaagtactcattaaaaaacatttatttaaaaaatgactacaaataatctatcttattatcagattgattacctcttattggtatgcagaaatataattggggcaacaaagactttctaaaaattgcaaactgcctacgaagtgtggctccctagttatggcctc

SEQ ID NO: 338443 - DNA, 358 bp, Homo sapiens
taacaaaaacaatccatttacctttggatgaacgggttagcttttgtttgttcattcagttatcagacatgtaatgattaatgccttgggtgtgccttgaacattatttatttataaagagcttgctgagaaatggtctatattagcaacaacagtaatgataattaatacttaattagcagtacaggccctgttctaatagttatatactttacatctgtcaactgctataggttcctccttatttttctactataaaatttatactaagcaccctttggcttgcctctttgtttctttagtagcaaaagaaagtatggaaaaaactgctctgaagagtagaacgtgcatcctgtca

SEQ ID NO: 338444 - DNA, 529 bp, Homo sapiens
ggaagagaccatgtgaagacagaggcagagatgggaatgatgctgccataaggcaagggacacctggggcttccagaagctggaaggggcaggaaggcctcctttcttagaggctttggagggagcacagccctgaggacactttgattttagaccactagcctccagaactgtgagagaataagtcattcccaatgctttaagccacccattttgtggtactttgttacagcagccctaggagactaacacaggcacgggtgatgcaaagacagaaaggttatccaggtaggactgatagaatgacacaagcccttcaagcagagagctttgtctggctggtggcagaggagaagtcaaagggaatcaaatcctgacaaggatctaacatgccactgccaatttgaagatggagagccacacgggaagggaagaatgcaggtgacttttaggagcagagagcatcccctagctaatagtcagcaaagaaagcaggtgatatggtttggatctgtgtccccacgaaatc

SEQ ID NO: 338445 - DNA, 303 bp, Homo sapiens
taaacgagacacctgaaacagagttttaagtctataaactcactgaaactaaaatagcagcacttttaggtgatgggctatatcttccactagaggtgagaaagaagtagaagaatatggttcatccatggataatggcagacgagagttgctgcgcaaaaatgcacagccgtgatctttgcaggctcatgagatatgttgcttccaggacatgaaatatcatgccttgagtcaacaagctcccagcatatggtgaggtgaaggccgagggagactgtactcgaaccagccaagaggaacggg

SEQ ID NO: 338446 - DNA, 155 bp, Homo sapiens
cttccaatccctgcatagcccaaactctgtgcgatgtgaaccagccacttcccctctgtgcagttggcctggggacatttgggggtcctggggtggtcagaagagagaataggctccaggagtggcatggggtcccctcttctccagagtggtct

SEQ ID NO: 338447 - DNA, 445 bp, Homo sapiens
agacatgcagtttcagcttagtgtgaagggtcctttcagtcctgcttcttggctccacagactcctccagcttctcggatccaccagcccagccctcattctttcatggtcagcaaccccatagccaggtctgtccagctgggacacaagcggatagtaataaggttgggcaaagtgccccaggagtggggagggggcagagagctggaactggggagactgggagggtcctctcttattggggagtaaagacagagagctgtggttcttctcttttgagactctggactgcttgtaaggtcagaaatggtctatctgccacttggtaccagaccgctgatctagaccattttcatacctgcctcctgtctcttgtttctacttagattttcaattctcctcatcccatctctcctaacttctttaccctctaccccttcttaac

SEQ ID NO: 338448 - DNA, 253 bp, Homo sapiens
ccagatatttgattgtccacttgacttctccacttgaatgcctaatagccataacaaacttaacatacttaaaattcttgacttccacctctaactgctccttccccagtactggtctcagtaaatggtatcaccaatcatccagtacctaagcataggatttatcattatatcaacaatttccatcagctttactttcaaaatatatttggcatccaggtactttctgccaccttcacgactaccacaccag

SEQ ID NO: 338449 - DNA, 669 bp, Homo sapiens
aaacaaaaaaccagcaacaccttttctaggaatatgctcaaagaaacttatacatgagcacttgattcatgaaatggtgtaccttgttcacaaaacattgcaacttgtttcaccattcattggataatgtgatagatttacaacagaaaatatttggctgggcacagtttctcacgcctgtaatcccagcattttgggaggcagaggcgggtggattaactgaggtcaggagtttaagaccagcctgaccaacatggtgaaaccctgtctttactaaaaatacaaaaattagttgggcgtggtggcaggtgcctgtaatgccggctacttggaaggctgaggcaggagaattgctgaaacccgggagacagaggttgcagtgagctgagatctagccaacaagtgaaactcaatctcaaaaaaaaacaaaaagaaagaaagaaagaaaaagaaaatatttgtacagcagtgaaaatggatgaactatagctgcaggcaacaacatggagaaatctccaaaatctaatgttatatgaagaaagtacatcccataagactacatacagtataatactatttctataaaacaaagcctagtaagataaagcagaatatcattaagtatacatttatctgtgatattgcaggttttgtttttttgtttgtttg

SEQ ID NO: 338450 - DNA, 818 bp, Homo sapiens
ttgggaaataaaatttttaataattctcagttcttttcaaggcttgaattgttttctgtccttcagggttcacatattttgtgtatggtatagctcactggcttttgcagggccccttaaagtccagtaacaattgccatcagtaaatgcttaccatgaggcagaccaagcacttgaatagtccagtgaggtacaggtacaactgctatagtttacaattgaagaggctcagaggtaaagtggttcaggtagccagtgagtggcagagtagggattcagacccagaacattcataatatttatttgtgtgcataacaagtagttgtaatgtcagttaaaagtttgtattcccattttggttttctatgtctagagtggcacctagggctgaaggtgattgacactagaggtacttaactacttccagagaatttctacattagcttattttaagtgcatgaattctagggaaaaatattttaccctttgcagatgccacccctaagagatgcaccaacaaatagatgacatgaaattaagcattagtgaatgctgttgatacgaaatatgatcttcaaacataaaggaatcaaatgaacaaactttgtttacaggggaggaggtggtgagggaaaggtttgaaatactcaggtgagtaggattcctacagctgcatagtgagatttgtaaggttctggtaagtttctgcagctgaaggacttctgcattcacctcttttgtaaatattatggaattttaaaaggaaggatggttgcctctggggaagggaactgggaactgaggttattttggagggg

SEQ ID NO: 338451 - DNA, 640 bp, Homo sapiens
aatgggtcaaaaccacaatcatgcgctccaggctcacatctggtgaccaggggccaccactaggatccagggtctctgctcctcgtatagagcagacagccccatagcatcactatcaactcctgcctgctgcaatcacgtcttccctggatggaaggaacatttcatgtctcctaaagactgcgttaatatgttgggttgctgaaggacatcaacactcaggccttaagaatttcctggggtgaacacagaataataaaacctccccgggtgctaattcaacaatcatagtccagttttcttcttccaggtttcaatttttgacaccaatcattgtgatgtttgagaatgtccccgtgactgcaggatctccatggtaaccttgttattttctttctttctttttttttgaagatggaatctcgctctgttgcccaggctggagtgcagtagcacgatctcggctcactgcaacctccactttccgggttcaagcaattctctgcctcagcctcttgagtagctgggatcacaggcatgcaccactacacccggctaattttttgtattttagcagagacggaatttcaccacgttgcccaggctggtcttgaactcctgagttcaggcaatctgcctg

SEQ ID NO: 338452 - DNA, 393 bp, Homo sapiens
tgccccagtctcaaggctggcaaggaccagagcctttccattcttagaaaccttctagagttcctttctggagcttttatggagcctgactatttttcctgttttttttttttctttaaacctcatatgtcctgagaatgcacaaaaactggttttcatcactgactaagtccatttatttgtttattcccaacatggcctcctaccttttacttgtaacaggacactatcatactagaggatttgttctccctcttcatgagcatatccacactacagacagatgggtgcttaaagtcttaatctataaacttgatatttcttataatttttattgaattaaaattcttcctaatgaataggaatttcctattccttacttaattctatata

SEQ ID NO: 338453 - DNA, 519 bp, Homo sapiens
acctcctccctcatgcccctccaggcaagttttcactgacacttgcagaaaccctacaacaaccgtctttcttgctcatctcctcagagacgaccttctggagcaactgctgctcaccagaatggctgtctgatttttatactccaagatcaaaggtcttagatgtctagttcacagaatctagaagaaggagaagacttcaaacatcattctagactaacctccttcattcacaaatgggactcacaaaggatgtatgatatgtggctaattagtcctagaaccaatctagatttttgtgagcgaaatgttctttgtattctaacacgttgctttttaggtctcaatattggaaaagataagatctctaaaattaatatttgaggcatttgctacaggttaatagcacacatatttgagggcagtttgtctttctgacatctcacaactcataccccttagccaaccagctaccctgcccatccatagggtaagtccacttccaacaggctcttcatg

SEQ ID NO: 338454 - DNA, 158 bp, Homo sapiens
tggtggtccacggtgtagcatggctcgggggacccaagaactcgatggcaaagctgcttcaaattctcctgcatgcttgctcttttctttttgccctttttcttctttcttccccttccttcctctccttcttcctctccttctttctctccttcttc

SEQ ID NO: 338455 - DNA, 360 bp, Homo sapiens
gatggacaggaaaagtcacaaaggtgcaggcaagctgggcctgccgcacaggaacttggccaaggaaaggcacagctggcctgcagctgctgggggtgccagcgcaagaagtcatgtagccaaccccatggcgaccaacaagggccactgtccctcaaaggcggccccaccagcacaaaagatggaaagtggaagctggctgggggggcttcacctggggaggacctgtccagcaaagagctgcgagtcactgatgagcatacgcacaagctctcccaacttcctgcagcaacccctcatcctgcccagtccctgcggccccgcccacccagctctcctggactcacccccaggaatacg

SEQ ID NO: 338456 - DNA, 290 bp, Homo sapiens
caaaagttaccttctcaggaaaacatcccatgatcatcctatttaaaaatggaggctgaggcgggcagatcacgtggtcaggagatcgagaccaccctggctaacatggtgaaatcccgtctctactaaaaatacaaaaaattagccgggcatggtggcaggtgcctgtagtcccagctactcgggaggctgaggaaggagaatggcgtgaacccgggaggcagagcttgcagtgagctgagatcgctccactgcactccaacctgggcaacagagcaagactctgtctc

SEQ ID NO: 338457 - DNA, 370 bp, Homo sapiens
aatggtgatagtgggccggaagagagagagtgcattcgaaagacactgaggagattgcatcagtaggacttggtgacacattagatgcagaggaagagggacagaaatgcttcaaggaggacttttaggcatctgtcttgggtaactagatgatgccaatggctgagatggggaattcttgggtagatgaggtttggtgggatggtgattgttataactttgactttgaacgtgctgagttcaggtgacattgtgataccccaaaggaggtgcagagtaggtagctggagacacaggcccgaagatgatgagaggtctggcctagaaacatggatgcaggagtcatggatccatcaaggcactgtgagtt

SEQ ID NO: 338458 - DNA, 390 bp, Homo sapiens
atccagcaaatttgaagatatcaattaagcaattcggtctgaagtctcagaagaaaaacaaatgaagaaaaataaacagagcctaggtgtggagcaccataaagcatactaacataggtatagtgagagtccttgaagaaaatgagaaaaaaaaaaaaaagaaaatttgaagacataatatctgaaaacttctcaaatttgatgaaagacataaatctatacatccaggaagctcaacacattccaaatagaaaaaactcagagacatctacatagagacacattataatcaaactgtgaaaatacaaagacagtaagagaatcttgaaagcatcagatgaaaagcaaatcatcacatacaaggggatcctcaaaattaacagttcattt

SEQ ID NO: 338459 - DNA, 550 bp, Homo sapiens
tttcaatagtggatggaacatccagacagatgatcaaaaggaaacagtgaacttgaacaacactatagatcaaatggacctaacagaaacatagaacattccacccaaagcaacaaaatatacattcttttcaagtacacacagaacattctccagaatagatcacatgctaggtcacaaaacaaactgaagaagattgaaatcataccatgtatattttctgaccacaatggaatgaaactagaaatcaatatcagaaaaaaaactggcaaattcaaaaatatgtggaaattaaacaatacactcctaaataaccaatgggtgaaacaaaaaaatcaaaagggaaattagaaaatattttgagataaatgaaaaacaaaatagaatgtacaaaaccgatggaatgcagcaaaatcagtaccaagaggaaaattatagtgacaaatgcctacattaaaaaagaaaaatctcaaataacccaactttacacctcaagaaactagaaaaataaggaaaaaaagctaatcccaaagttacttgaaggaaagaa

SEQ ID NO: 338460 - DNA, 409 bp, Homo sapiens
gctagcatgaggcccatgttcatgcagaagtgagctctggctcatgcagacaggagggagagagggctggagagaggagggatggagaagtaagtgaggagacagaagagaggatagtgagaaatggggaaggagaaggagaaacagatggaaaccagagaacaacagaagagggagaggaaaagacagaggagagaaggaagaaggtgggaaagatttggaaggaatagcacatgaagaaggagtgaaaagaaactgatgctcaaaagtgggccaaagagctggaaagggagaagggggaaggagagccacccaccagagagggaggaagattggagccggcggagaggagggggcgggaagctgccactgtgtccgatgtcctgcagcctggcgttgtacgctgccc

SEQ ID NO: 338461 - DNA, 309 bp, Homo sapiens
tacatttatccaaagaacatataaggatgatagcgaaataggggtaccgattgcgatttagtatatcgggtcgtagcgtgaaaagacagaggagagaaggaagaaggtgggaaagatttggaaggaatagcacatgaagaaggagtgaaaagaaactgatgctcaaaagtgggccaaagagctggaaagggagaagggggaaggagagccacccaccagagagggaggaagattggagccggcggagaggagggggcgggaagctgccactgtgtccgatgtcctgcagcctggcgttgtacgctgccc

SEQ ID NO: 338462 - DNA, 661 bp, Homo sapiens
ctttgaggcctagtttcctcatctgtaaaatgaggatgataatactttcgttaaaggatgattgagtagatgcaaagaaatgaagtatgtaatgtgtccaagtcatttacttttctttttatatttccttaaagttgtatactcttgtcagtagagagatttaagcagaatatcagccagggtggagtggattcttgttctcctccataggagatgggacaggatgatctactggtccttttcagttagtcctgaggggctgggatttaagcatccatgggtatctgatgagaagggacagtctctgattctgatggggaggagtttggtgggccctgggctgtctgctctccatggccctatgagagagttctagagaaaactatggagcaaccacacttttcttacatgattactaagggagaagatgcaggcagctaccggaaggggagctgactcttggaagaagggaaaggcttagggtgaatttctcattttctacagcttttctcttgagtacagccttcagtctgtgccatgtgggaagatagataacttgatagaaaatatgtatcttggttggcttggataaccagagactagagttcaggacaaccttagctgctggaaggagtggggtctctgaaaggagtgagccaca

SEQ ID NO: 338463 - DNA, 483 bp, Homo sapiens
aattgtaatccccctcccaataggggcaatttgggtcccgggccccccctcgtgcttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338464 - DNA, 406 bp, Homo sapiens
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcgtgagttcccccattgtcccccaacgccccaccgcccccatgttctcccactcgcttctcccctgagaacctccaccccgcccccagcctgacacccgttgtctcagcacacctgtgcaagcattttcagaccaacgaagtcacagcccaggggaatgctgggactgactccacggccacgcccacctcccccacttcctt

SEQ ID NO: 338465 - DNA, 1798 bp, Homo sapiens
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338466 - DNA, 1772 bp, Homo sapiens
gccacgtcagccaatcggctcaggccctgccctggaaacgacacctgttcatcctcctcccggcaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338467 - DNA, 1623 bp, Homo sapiens
gccgggctctccccggtctagaatgtaacactcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338468 - DNA, 1739 bp, Homo sapiens
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338469 - DNA, 1628 bp, Homo sapiens
gctggacagcaggctgggcccagataagatgtcagctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338470 - DNA, 1744 bp, Homo sapiens
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattcttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctccaaaaaaggatctc

SEQ ID NO: 338471 - DNA, 1028 bp, Homo sapiens
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgcgtgtcacggcttgactggcggtggcgcgccctgcctgtcggcgtgcgcatgtgttgggctgtctgctgctggtcgtggtgtggcgcgcgtaggggtgcggagcctcctctgtgatctcccaggcggggcggcttcctcgaattgtgggggaa

SEQ ID NO: 338472 - DNA, 307 bp, Homo sapiens
attttaatagcattaacaatttttccccaatgaagcaaataaatccaatttgtacttaccatttactgggcactacagtgccaaaacactatgctatttacaacaggacctcacttaatccttaccatgtcccgtggaatacagataacttcattttatacatgaggaaacaggcttttaagcaatattcccaagatcacacagatagtatattagaaagtaaagtgttcagctgcaaatacaaatagtggtttctttctccccctgtcccctccctgccactgctattgaaacttctaaaactagg

SEQ ID NO: 338473 - DNA, 421 bp, Homo sapiens
gctttttctcttgggctcttaagtttatgcagaaagactcctctagcctcatgactagggaaagcagaatttgactctagtatccagcactgtgtgacagaagcagaaaaagtgctgggagcagcgagaggcctcgctggtgagcatgtggactttccctcattccctctggtatagaactgcatttcacacatgcccctcttagcctggcctgctgtgcctgatcttaatcgggtcttaaaactgagcatgttcctggaaagagccttaaaggaaatactaatttaccaggaagaaaaaaaaacaaacacaaacattttacaggcatagatttataaatagcctcacatcagtccaaatcaggttttgccaccaaatgggttaagaataaagcttgactttcacaaatttttggacttga

SEQ ID NO: 338474 - DNA, 315 bp, Homo sapiens
atgcatgagctactgtgcccagccttggtttttcttttgagacagtgttttgctctgtcacccaggctggagtgcagtggtgtagtcatagctcactgcagcctcaaagtcctgagttcaagcaatcctcttgcctcagcctcccaacgtgctgggatctcaggcaggagccactgcacctggcccgaaaccaagctttcttatcccaagcgctgacctttatcaagttgacctaatcctttatcatctcctaagtgtccctcatgagtgatcacttcacattcctcccacatggagagctcacccactggggca

SEQ ID NO: 338475 - DNA, 338 bp, Homo sapiens
aatggattttcagtagcctcacttttgttggagctgctgcattagttcaagtcctgctccgttctgtctggcttttcctttactgattgtgcttggagaggccgtgttctgacttgcccactgtgcctagtatcaaaggactcaagttctaaatccagctcattgttcttttgcggggtctggtagagaagctgctcaggcttttggtttgctgttggcataaggagtctctcctctgttcgcatgcagaagagattagagatgtgcaaagcccactcatccggagtccaaggcctaagtgattcctcactctccagtcggttgggaaaaacctttag

SEQ ID NO: 338476 - DNA, 374 bp, Homo sapiens
tgctgagtcctcacagggatggagcccagtgcctgggtcctaacagggcagaggtggggtgtctcttgttacaaagatcccttccttcctgccacagctttcttgccacctgacatcccccaccttctgagtcatttcttggggttcaaaagtggttttccattgcaaagcaaatacttttggaattcttgaattccgaaattcaagaactccgaaagtatttcagagcaggagaacaaatggatgtgatctggctgctgtgtactgaatgtttgtctctccccaaattagcatgctgaagccttcaccctcagtgtcatggtatttggagatagagcttttaggaggtaattaaggttaggtgaggtcatagg

SEQ ID NO: 338477 - DNA, 396 bp, Homo sapiens
agctttccttaagcccaattaacctgacacaaccttttctcactctttcaagctcatctatttaaaaaatagtactacctaaaatatctgcacaccctatttcacaatcttttgataaactaggaaataaaagaacatcttgttactataaacgtgtaatcctcccttctaagaaaaaacacttgtaccaagtccagctaacatgatccattaagaacaactagttctttcttacaggctaacactgactagacatggagaacttgaactttaaaaataaatactcaacaatattcccaacatctagatgttcaaactgctcactaaattatgcattcctaagcacgcatccatctctctgtggacacaccaggaaaacgtctctctaaattataa

SEQ ID NO: 338478 - DNA, 715 bp, Homo sapiens
ctggatcagtgtcctttggacactttgctcttggttttgaacatgtcacctattctgaaatttaaatgagttctgaaatttataaggaccttcactgtagtgttccctttttggggacggccaggttttctaagcccagaggaagaccaccacccatggagcacagaagagactgaatacctgccctctcagtccactcctgcaaccactaccaatgaagacaccaaaatgacacacacgccttgaagggcagagagaaaagggaggaagaccttggatgtgatgattgaccaggcagagaaaactggaccgcctgggacccaagggatgaagctgggactgcctagggcagcaatgtccaatcttggctaccctgggccacaatggaagaagaattgtcttggaccacacacaaaatatactaacacaacagctggtgaaccaaaccaaaacaaaaacccccaaaatctcaatgttttattagaaatttgtgttgggtcgggttcaaagccatcctgggccacatgcggcctaagggttggacaagcttggtctaggggagcagctgcagcagggcttaggcctgcgctgagccatgacaacacacttgagccatgaaattccagaataattcctgagagttctatatgccccagcagatccacacacaagcaactggagctccgcccacccccaccccccaccaagagacagg

SEQ ID NO: 338479 - DNA, 86 bp, Homo sapiens
tgctggaaggtctgtgtggacaattctgtgagctgaaaattcaggaggcactctgatagggggcccccacaatcttgcaatattta

SEQ ID NO: 338480 - DNA, 1019 bp, Homo sapiens
gaagggagctgagctacttgtcaaaggcagaagagcatgtggtgaccggttggacagacggggtgggcactaagtataagatttcagtcttgcaatgtgctgggcagtgatgcctttacctgagacagcacaggaggggaagctggcatgtgcttcttggatgtcttacagacatctgaaactcatggtccctctcttccctgctctcaaataaggtcccctttcagggtccagtagaataagctgggaacttcaaggtcattcttgtcactttcctctcccttgcctgacatatccattccatcaccaagcttagtaggtcttattttctaaatctctcctcaattcccctccaccccatcactactcctgttccagctgcagctatatctcacctgggctcctgccattgcttcctgaatagcctcacacatctaccccacttcactcctccacatctcttctccatgcacagaggtgtttgtgcaaactacaactctagtctgtcaccctagtatgcctaggaatgcaaaactctgaaatgaggcccatgggccctgccaggcatagtccttcccttggctgcccctgctgcatcatctccatctcatggcctcctttcagtccacactcttaccgggattattccatgcacatagctgctctccattcccgagacattcttccctccctcctttgcctgattaatttctgtgtatctttcccttctcagctcacatctcagttctcagggaagcctgccctgatctctgggactaaatcaaacttcctcaatataggcttggctataaggtatcaccttttcaaagttgcagtttacatttgtttgtggggtttcttttacatttgtttacatttgtttgtggggtttctgtctctctcttctgctagctacaagcttcatgaggtcagggccttatctgtgttcaccattatatccctgacacttaaaatgcataccttcaaagaacacccttggatggatgaaaggtggatct

SEQ ID NO: 338481 - DNA, 765 bp, Homo sapiens
gaagggagctgagctacttgtcaaaggcagaagagcatgtggtgaccggttggacagacggggtgggcactaagtataagatttcagtcttgcaatgtgctgggcagtgatgcctttacctgagacagcacaggaggggaagctggcatgtgcttcttggatgtcttacagacatctgaaactcatggtccctctcttccctgctctcaaataaggtcccctttcagggtccagtagaataagctgggaacttcaaggtcattcttgtcactttcctctcccttgcctgacatatccattccatcaccaagcttagtaggtcttattttctaaatctctcctcaattcccctccaccccatcactactcctgttccagctgcagctatatctcacctgggctcctgccattgcttcctgaatagcctcacacatctaccccacttcactcctccacatctcttctccatgcacagaggtgtttgtgcaaactacaactctagtctgtcaccctagtatgcctaggaatgcaaaactctgaaatgaggcccatgggccctgccaggcatagtccttcccttggctgcccctgctgcatcatctccatctcatggcctcctttcagtccacactcttaccgggattattccatgcacatagctgctctccattcccgagacattcttccctccctcctttgcctgattaatttcttagtggcttccggtgcaataaaatctaacttccctcagcaggcagcattcag

SEQ ID NO: 338482 - DNA, 720 bp, Homo sapiens
agatatattaataaatgtcatacattcagtagaaggtctgattaaaaaaagataaaggacaattgatagacataaaacttcagtacctttttaataacatttctgaataatttaatatgtcctctgaacttacatatactaagtttttccatagggcatatagtaagtgttatactctgagattctgataccaatttctagttcttcctcattaagaaacattaaaagcccgttatttatttcaattaaaaaaattttttattattatactttaagttctggggtacatgtgcagaacctgcaggtttgttacataggtatacatgtgccatggtggtttgctgcacccatcaacctgtcatgcacattaggtatttcttctaatgctgtcccttccctagccccctacccactgacaggccccggtgtgtgatgttcccctccctgtgtccatgtgctctcattattcaactcccacttatgagtgagaaaatgtggtgtttggttttctgtcctgtgttagtttgctgagaatgatggtttccagcttcatccatgttcctgcaaaggacatgaactcatcgtttttgatggctgtttagtattccatggtgtatatgtgccacattttctttatccaatctatcattgatgggcatttgggttggttccaggtctttgctattgtgaatagtgcctcagtaaacatacgtgtgcatg

SEQ ID NO: 338483 - DNA, 130 bp, Homo sapiens
ctttcatcctctagccaagcctctggagccgcgtcagtcccactggccagctgtgctcctgcagtcttgttgatctctgtcacacccacactgcccaggctggagggctcctttctcctcaggaagtcat

SEQ ID NO: 338484 - DNA, 511 bp, Homo sapiens
cctatccatatttttatagcaatgtcccattcctcaaaaccaaatttctgtgttaggctgttattgcattgctataaagaaatatctgagactgggtaatgtgtaaagaaaagaggtttaattgactcacagttctgcaggctgtacatgaagcatggtgtcagcatctgcttggcttcttgtgaggagttgggcttcttacaatcatggcaaaaagcaaagcaggggtaggcacatcacatgtgaaagcaggagcaaagggtggggaaggtgccacacacttttccttttttttttttttttgtggaaatggagttccactcttttggcccaggttgaagggcagtggcgcattcttggctcatggcaacctctgcctccggggttcaagtgattctccgtgcccaagcctcccgagtagctgggaccacgggcttgcaccaccacgccgggctaattttgtattcttagtagagacagggtttctccatgttggtcaggctggtctcaa

SEQ ID NO: 338485 - DNA, 436 bp, Homo sapiens
ttattttaagtaagatgttacttttgttttaaagaatatatgaaagagaaatattaattagatttttcataaatgcttttgaagtttataagttttgaattacaaattagtaatctaaaattaaccagaacttttattggagcctcaaaaaaagctttcaaagtagaactggaagaaaattataatttatgatcttgttcatctttcttctttgctgttctcgtgtagtgatagacgtgttaatgaaaagttttatgcataggaaattgactatcttgaatcatgattatccattgactttcactgtaatttcttatatttcttgttaaaagggaggatggggaatcagattttagaattttctttaaaggagttctgtcattctcctaaataacatacttttttcttctgtgtctgatatatttccatttaattg

SEQ ID NO: 338486 - DNA, 711 bp, Homo sapiens
ggtgatgggccgcacagcgaggcagtcaaggccagctccctgggagaagcactgggtcaggtgaggtctgaggacagcaggccttccctaggggaaggagctgggagtgccaaggccccaggtgcacaggaggcgtggctgctgagaggctgcagggtggaggggcctcggcctcagagtcatgtgccctgtgaccactgaagggtgtcagcagagcacacggcatgaggacagagggaggggcacggggagtgaaggagggggccctggggcaaggctcgggggtcaggagctcagcgtccgctactcagcccagccaaaaccctcccagacgtctcctctcctgcctgggcaaagtccagcttggcaccccgtctggggcctgcctgtggtcagggccaagtgttccctcctccaggaaagcctttaccctcctcatgccctgtagtcaggaggccgcctgctgtaaccctccgtgtcgcctcgggtgcgaaatcagacccacctgacaccatcacgcggaggcccagcagcacctgcacccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaatta

SEQ ID NO: 338487 - DNA, 667 bp, Homo sapiens
aggggcaagtgtaggctgccaaaaaatgtctaattagctctccctccaggcctgggtcattagagcagtgaagaaaaccaacaggcagaagccagggacagctgagggctggctgtgccaacctagtccatcctgccccacctaacagagcccagatctattaggctctgctgacagccaggcagggaaccccaaggaaccagcaccatgctcccgtgccctcacagatcccgtgttccttcaccctcatatttccatgacaggtttttagcagaaggtcagtgtatttcttcatgaaaataattgcaaaaaaagtgccatagtgttttgttttgttttgctttgttttttgaaaccaatgtagtgaggccaggctggtctcgaactcctacctcacgtgatccgcccacctctgcctcccaaagtggtgggattacaggcatgagccaccgcgcccagccatgaaatggtttctaatgacacatttcccagagtgcccagtggttcttactgccctaggtaagctgcctctcagactcctcaaagcagctttacctgcttcctagacctgtatcctaacactcatccccatagatactaagctgtaaagggattaactgctaatgtggaacttcatccaagaaatgattagggatattacagatgt

SEQ ID NO: 338488 - DNA, 528 bp, Homo sapiens
aggggcaagtgtaggctgccaaaaaatgtctaattagctctccctccaggcctgggtcattagagcagtgaagaaaaccaacaggcagaagccagggacagctgagggctggctgtgccaacctagtccatcctgccccacctaacagagcccagatctattaggctctgctgacagccaggcagggaaccccaaggaaccagcaccatgctcccgtgccctcacagatcccgtgttccttcaccctcatatttccatgacaggtttttagcagaaggtcagtgtatttcttcatgaaaataattgcaaaaaaagtgccatagtgttttgttttgttttgctttgttttttggagacaaggtttttctctgtcacctgggctggaatgcagtggcatgatctcagctcactgcaacctctgcctcccaggttcaagtgattcttgtttctcagcctcccaggtagctgggattacaggcgtgtgccaccacatccagctaatttttgtatttttaggagagagggagt

SEQ ID NO: 338489 - DNA, 771 bp, Homo sapiens
caactcaggaggctggggcaggagaatggcttgaacctaggagacagaggttgcggtgagccgagatgacaccactgcactccagcctgacaacagagtgaggctctgatacaaaaaaaagaagaaataacactctttgtatctattagaaatagacttttaaattccacctctctcatttcaacttagacaaagaagtagcaagcacttataagagagtattttcactatgcaattatatgataacatgtacagggattatttttgaactttaagtggtgaattcaaatctggttatattttatctctgagtgagcgcctttataaaaactttttagaattatataatgtttaacctggaaagaactttgaataggaaactagggcccggaaaacatgaatgatttgctgtatcagttagtagctaagctgggacttagcttcagaatgtaaacatttgtcaaacttaattgcaggagttgtcataagccgaccaggatgtgactcatagagtattgtgcaaattaagctctttgtactgtatatgaaaaatggttttttgttttttaaggaagctaactttggtattggttggacatgatctccagagaggtatctatctgtgttagagtgttctggtttggtgtttccaaaagtatttttctgaaataatactataatcatgtgacttgcactgacagtattgatggttgtttattaatgtatattatctggtcctacaaatgtgctttttctttttaatccctatgt

SEQ ID NO: 338490 - DNA, 335 bp, Homo sapiens
gtgtgtgtgtgaccgtccgtgtgtgaccgtccgtgtgagcttccgtgtgaccgtccgtgtgagcttccgtgtgaccgtccgtgtgagcatctgtgtgaccgttcgtgtgagtgaccgtccgtgtgagcttccgtgtgaccgtccgtgtgagcatctgtgtgaccgtgtgtgtgtgaccgtccgtgtgtgaccgtccatgtgagcgtgtcaccgtccgtgtgagcatccgtgtgaccatccgtgtgagcgtgtgagcatccgtgtgacccgtgtgcacacgctgctgcccacaccctctaacacctgtctccttatcgtcacatggccactcaata

SEQ ID NO: 338491 - DNA, 399 bp, Homo sapiens
tagacaatcagagagccaaatcatgaatgaactcccaatcacatggccactcaataccggtattgagtgtccgtgtgagcctgtgagcatccgtgtgaccgtccgtgtgagcatccctgtgaccgtccgtgtgagcgtgtgactgtccgtgtgagcttccgtgtgaccgtccgtgtgagcatctgtgtgaccgttcgtgtgagtgttgtccgcataaccgtatgagcatccgtgtgatcatccgtaaccgtgtaggcgtccttgtgagcctccgtgtgagcgtgcaaccgtctgtgtgaccgtccgtgtaagcgtgtgaccttccgtgtgagcgtgtgcacacgctgctgcccacaccctctaacacctgtctccttatcgtcacatggccactcaata

SEQ ID NO: 338492 - DNA, 822 bp, Homo sapiens
gtgtgtgtgtgaccgtccgtgtgtgaccgtccgtgtgagcttccgtgtgaccgtccgtgtgagcttccgtgtgaccgtccgtgtgagcatctgtgtgaccgttcgtgtgagtgaccgtccgtgtgagcttccgtgtgaccgtccgtgtgagcatctgtgtgaccgtgtgtgtgtgaccgtccgtgtgtgaccgtccatgtgagcgtgtcaccgtccgtgtgagcatccgtgtgaccatccgtgtgagcgtgtgagcatccgtgtgaccgtccgtgtgagcatccgtgtgaccgtgtgagcctgtgagcatccgtgtgaccgtccgtgtgagcatccctgtgaccgtccgtgtgagcttccgtgtgactgtccgtgtgagcatccgtgtgtgaccgtccgtgtgagcgtgtgaccgtccgtgtgagcatccgtgtgaccatccgtgtgagcgtgtgagcatccgtgtgaccgtccgtgtgagcatccgtgtgactgtccgtgtgagcctgtgagcatccgtgtgaccgtccgtgtgagcatccctgtgaccgtccgtgtgagcttccgtgtgaccgtccgtgtgagcatctgtgtgaccgttcgtgtgagtgtgtgaccgtccgtgtgagtgtccgcataaccgtatgagcatccgtgtgatcatccgtaaccgtgtaggcgtccttgtgagcctccgtgtgagcgtgcaaccgtctgtgtgaccgtccgtgtaagcgtgtgaccttccgtgtgagcgtgtgcacacgctgctgcccacaccctctaacacctgtctccttatcgtcacatggccactcaata

SEQ ID NO: 338493 - DNA, 391 bp, Homo sapiens
tgtgaccgtccgtgtgagcatccctgtgaccgtccgtgtgagcgtgtgactgtccgtgtgagcttccgtgtgaccgtccgtgtgagcatctgtgtgaccgttcgtgtgagtgtgtgaccgtccgtgtgagcttccgtgtgaccgtccgtgtgagcatctgtgtgaccgttcgtgtgagtgtgtgaccgtccgtgtgagtgtccgcataaccgtatgagcatccgtgtgatcatccgtaaccgtgtaggcgtccttgtgagcctccgtgtgagcgtgcaaccgtctgtgtgaccgtccgtgtaagcgtgtgaccttccgtgtgagcgtgtgcacacgctgctgcccacaccctctaacacctgtctccttatcgtcacatggccactcaata

SEQ ID NO: 338494 - DNA, 222 bp, Homo sapiens
ttcaactccattacccattttgatattattctgaaacattattacccagaaatgagacttgtgaggctttgacaggatgtggtgcatttaaaaatttacctaaataggatagttttgatagggctattaaatgactcataataaaagctaaacacagaaagagtatatcaactcccaggttgacattcagtttctgtctctcccctcttggctttatcgtaa

SEQ ID NO: 338495 - DNA, 246 bp, Homo sapiens
tccataatgtaagttttttttttaatgaaataccccaattggtattttctttccgtttttgtaactcacagataaataagatgctggttgactcaatagtacttcaaacacatttcaataatctttagagagcagagtttccaggttttatgttaagtatgtagaagattcagttactgaataaaggacaaactgtaagataacctgctacacctaaaacccccaatctgttaggatgaaatttgg

SEQ ID NO: 338496 - DNA, 615 bp, Homo sapiens
gcaagggcaagcctttccatgtcaatagcatataaagcataagggtgggaatcaaggactataaaggggtagttgggggcccagccatgaaaagccaagtatactctatgaaggcttagagcatatgcttctagctgatggggaactgttgaaaaattttaagcaggggtgtaaatggccagattttcctggtttgctatggcagctcattgagtcatagatttgtggctggatagcaggaaccgatcatgataggctcaatgtgagatgatgaatatgtgtaagaaagcagtgaaagtcagggctggagaggagaagatgggtttgagaagtacacaagatttggagttgatacaattttgatcaactggctacggggagtggatgagatggaagagaccagaatgacacttgaagttctggtggccattttgaacctggggaatataggaggaagaatgggtatgtaggggccaaggtaatatactgattttaaaaagtgtccatctggcaattgaatgtgagtctgacgctctgggaagatggcgtctggagatgggaatctgggagccatcacctagaggtggtagttagagccatgtgagtaggttggtg

SEQ ID NO: 338497 - DNA, 181 bp, Homo sapiens
caggctggtctccaactcctggcctcaagcaatcctcccatttcagcttcccaaagtcctgggattacaggtgtgagccaccatgcccggccaactatgggctattttttagtttgccttttgtactgcttttagagttttttgatgaatttcctttatacttgctcttggattttttatt

SEQ ID NO: 338498 - DNA, 228 bp, Homo sapiens
gggcacagaacagcattgctgcctgtttgagcttttgccctagtgggtagggggcacccagtaaacatggggtgccatgtcaggttgtgataaatgctgtgaagaggtgcaaagccaagtagagggatggagagtcatgtttcgctaagtctccaggcctctccgagcaggtgacagttagaggaagagcgttccaggcagggggaatcacaccctggggtgagagag

SEQ ID NO: 338499 - DNA, 385 bp, Homo sapiens
tctagagtccctgctgtcctgccgctctcacagtcagtgcacactgacaaggctgcctataaagtttcaatgaaaatatgagacacacagtaaaagtctgccacaataaaaaaaaaacctatacaataggaatagttcattaatgataatgtacatgctatcttatattataatttacattgcatttttgtgactttccgtttttatttctttttaatgcatcttttgtctctaaactgacataattctagtatttattttttcagttaattttctgaacacagtacttaaaagccaaattgccagtttaaagccagatatctgacaacaccatcattagagattacatttgttctacaaacactcaacaaactctcaagggatg

SEQ ID NO: 338500 - DNA, 464 bp, Homo sapiens
ctgtgtataacctcataaagtaggaagaagcccagtgttgaactctacagccttttacattcaaaatggttttgaaaaatgcccattcagaggaacaggaaagcaccaaacctaaaaggtctgaggacctttccatgctttctgtctcctaatctcagagctgtaccaatctgttatttaaaaattagtcattatttatccaaggcaggaggggacaaatgtaactgttagttcagtaaatgatttcattcttttttttttcctgtgtcctttctactgttaaagtgacgaaaatgacaccacggtttgatatgtggggttggtttcagtttgaataatctcatccttagctgcatgtgaactcatgtcttctcacactctattagataaaagcctaaaacaggaaggccagaaacaactgtttttaaaaagctcatgctaccctggcaacttaagttggaaga

SEQ ID NO: 338501 - DNA, 1425 bp, Homo sapiens
tcctggcctgatctgagtagagaaaggtgggtaggagttaaccaggaaagcaaggatgaaagcgtgttgcgtttagataaaggataggcttcaaggtcagggaacgttgctgggtggtgagatggaaccctgatgtggaggctcagcaggaagaagcaggaaggacactgggcccctggtggttttagttccagaaacaaatgtgggccccagggctctgcaatggtaaggctggaactactcaacataagagctccacctttaactgtgccccctaagagtacctgatgatccccctatctccttgtcaatgttgctgttcttctccagaatctatttcaacccttctctgatttcaaaccaccagtccctttacctctcagagaaaacagcaaccacaaaagcctctccacttcctactatcttaatattgacaacttccagatcagggagctgagatatctcaagctcaggtttctcttctgagcttcagacgcttttatccacttggatttcactggcacaaaactttccatgttagaatcaaacccccctcctcccagacctgcttctcccacacacttccctatctgaatgaaagacacctccactctccacccagttgccaaatcagaaatctgtctttgttttctttgtctcacattttcctatgtctaatcagttaagttttatcaatactacctgtttatttctttaatctattcacatatctttatcctcaatcttcagcatccccttcccatcctcagtctgctggttactgtatttcctattttactaagaatctaaaagagatcagaagaaaacttccacatcccccaacacccaaccaccaaatctgctaacccagttgcattggtgcttttatagccttccttcctccctcttactaagaatgaaccaacactattcctatcaaagcccaaccctctagctttacattgactcctagtgtcttttttctggattgtcaatttttttcctgaccaattattctattagcaatacaaatatgctgtaaaatctcttaaacttttttctctgcatctttgaactgctgttctcttttccttctccccttcatagcagaactcctcaaaagagttgctacctctaattcttcccttccagttctctcatgaaccagctacaattaagtattcacccccaccactccatggaaactgctcttgtcaaaatcatcaatagcctttgtgtggtgaatccaatagccagttttcattcttcttactaagcttctcatcagtattcctagactatttccttcactggcttcgacaaatgctttcttggttttcctccaatttctcgactttgttcctgctgaatctacctttttctaatccgtaagtgttggggtgtcccagggcttactccttggac

SEQ ID NO: 338502 - DNA, 780 bp, Homo sapiens
tttttttgtatttttagtagagacgtggtttcaccgtgttagccaggatggtctcgatctcctgacctcatgatctacccgcctcggcctcccaaagtgctgggattacaggcgtgagccatggcgcccagcccaattttgtatttttagtagagacagggtttctccgtgttgggcgaaaacttccacatcccccaacacccaaccaccaaatctgctaacccagttgcattggtgcttttatagccttccttcctccctcttactaagaatgaaccaacactattcctatcaaagcccaaccctctagctttacattgactcctagtgtcttttttctggattgtcaatttttttcctgaccaattattctattagcaatacaaatatgctgtaaaatctcttaaacttttttctctgcatctttgaactgctgttctcttttccttctccccttcatagcagaactcctcaaaagagttgctacctctaattcttcccttccagttctctcatgaaccagctacaattaagtattcacccccaccactccatggaaactgctcttgtcaaaatcatcaatagcctttgtgtggtgaatccaatagccagttttcattcttcttactaagcttctcatcagtattcctagactatttccttcactggcttcgacaaatgctttcttggttttcctccaatttctcgactttgttcctgctgaatctacctttttctaatccgtaagtgttggggtgtcccagggcttactccttggac

SEQ ID NO: 338503 - DNA, 290 bp, Homo sapiens
cctcgaggggccctggccctggattttagatggggtcagagggtgggcttcgggaggcctgtgtgcaaagcagccatgctctgagttttactgaagggctcttgaaatcctcacccaaggtcacagtttgacttgtggtctgtttatgccttggatgtacccctggccctctttgtgggattgtggctactttttggggatggaggaagatgtggccattagtgtgagccaccctcattagacgggcacagatcggtgaggtttggaggagtggggtggtcacagcagcg

SEQ ID NO: 338504 - DNA, 4176 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctccttta

SEQ ID NO: 338505 - DNA, 634 bp, Homo sapiens
ttgcagtgcttggtaatggtgctaggaatactttggagtaacaatcagcacaaaccaaaatgaatgagatatattaatattttcattgtttttaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagtt

SEQ ID NO: 338506 - DNA, 424 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggacaccggtaatatgtaacctttgaggacaggactcagcctgcagggcccctggtatttatagggtccaagaggaggcacctgcttttcaactgcaccctcagtgctgcctctttttggcccctaaacgtttccctttgaggttgtgatgctgggaatcacagacttcactctctgcctgcacccttccccgaggtctcatcttttctgggtcccacaatctttgtaataatgtgaaaaagcacaatttgtctgatcaccccccaggtggttccccaccttattatcactacctgatccga

SEQ ID NO: 338507 - DNA, 8967 bp, Homo sapiens
  misc_feature (1)..(2): n is a, c, g, or t
  misc_feature (4)..(4): n is a, c, g, or t
  misc_feature (4946)..(4946): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatccaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacgtgactatgccttctggtcatcctangactatttggagttctccaaaaccttgtaagaggcatgtcaggcatgcagtaaaagcatctacaacttcagctgggcactggcagcataggtctcatcttggaccatacagtcccactttatagaagagagtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcattctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaaaacacctgatctacattgaaagggggtagactaacgtatgtgagaccattttcctatttgcagttacaaggttaaagaactttgaaggtcattcggctgctaagaggcatgtcgaacactctgtgtggctctttcacagtaaaccctcctaagagcagaagacacatggctgttagtgtctgcgtttagatttaatttctcaaataaaggcccttggctgcgtatcatttcatccagttataaactagggctcctgcaagcacccccattctaagggtgaattattgaaatcagttgctatttgatgagtcacaactggcccagcaggcagggcatttgaagtcatggtcatcaaaaagaaatgattgttttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagagaaatttaattttaaatatcaagtcctgtcaaacatttctcaaacttctgattttatcaaaggtttgccagccaataaagtgcatcccaagtatacaggggagaaagctagactcctacagggtcctagagtttaagtaatttttttgttattaatataggtaataatttttctaatttttattttttggttccaaatgtaaagctccttgtgtttacctctgtttatgtcattcttgacatgtttatctaaattatgtgtgctctgtgacaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaagccatagtgttttcatttgtcttttcttcaggatacacggtagaagtcagagaatctttgatacttttatttggtgcaataatcaaggccatgcaacaacccaaaatcaagcattttggttcaagtcaggatgacatgagtggggacagaagctgtggcagtcattcaaataatctcatgggtcctgaggaaaagacaggagttaatgtattaagtttctactatatgcaggaactgtgttaaatattttacataagttttgataatagctaacattagctgagcacaaaatttgggccctgatttgtgctgagtatctttcacagattactgcttttaatcagcagtccttgtgagctaggtatgatcattatccccattttatagattacagatgagattctgaggcacaaagaggctaagtaacttgccaaagatcatacgatgttaagtaatggcccctggattcagtctgcagcctgaattcttaaccaattatactgtgatttcattattcttcagaattacactaaaaagaaggtattattcccattttacagatgaggtatctaagctcagagaagctaaacaacttgtgcaacaatcactaagcttataagcagtggattagggttagatttagatatttgtctggcatccaaacctgtgctctccctacagtaccacatggtttccacagtctcatcagaccccggaatttcactccctgagactgcttaattgtgaatttcccaaactgattcaccaagagcctactgtctctgctttgtagatagctttgaccacattcaatgacattaggaaagactccatttcccaagatggctcagaaaatcagatgctatgacgcatgttgaaagtgaaaacccatctctgagaaagaagcatctgttttattagtaaaaaaaaaaaaatgaaatttacagcaatgttgtgtgacttctcaaaattctttcattttcttatttcagaatgaatagtgttgttcgttggctgggaatggggaagaatgtgatttttaaaaataaagcataatcaaactctgcataaaag

SEQ ID NO: 338508 - DNA, 6126 bp, Homo sapiens
  misc_feature (2105)..(2105): n is a, c, g, or t
ttttttagatgaagtttcactcttgttgcccaggctagagtgcaatggcacaatctcagctcactgcaacctctgcctcccgggttccagcgattctcttgctttagcttcccaagcagctgagattacaggcatgagccaccatgcccgactaattttgtatttttggcagagacagggtttcaccatgttggccaggctgatcatgaactccttacctcagatgatccacccactcgacttcccaaagtgctgggattacaggcgtaagccactgtgcccagcccatgaaactatttaaacaacatgtgattacttggccacttttctattcaaaaatatggtttattagtcctgattatgtgcccttcttggcagacagaatgatactgtgtacttctgctgaaagaaatagaaactctcttccattttctagataagagagtcctaaaacagaatttccaaaaactccagttagtggaggtaacttaaaatcctctttaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatccaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacgtgactatgccttctggtcatcctangactatttggagttctccaaaaccttgtaagaggcatgtcaggcatgcagtaaaagcatctacaacttcagctgggcactggcagcataggtctcatcttggaccatacagtcccactttatagaagagagtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcattctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaaaacacctgatctacattgaaagggggtagactaacgtatgtgagaccattttcctatttgcagttacaaggttaaagaactttgaaggtcattcggctgctaagaggcatgtcgaacactctgtgtggctctttcacagtaaaccctcctaagagcagaagacacatggctgttagtgtctgcgtttagatttaatttctcaaataaaggcccttggctgcgtatcatttcatccagttataaactagggctcctgcaagcacccccattctaagggtgaattattgaaatcagttgctatttgatgagtcacaactggcccagcaggcagggcatttgaagtcatggtcatcaaaaagaaatgattgttttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagagaaatttaattttaaatatcaagtcctgtcaaacatttctcaaacttctgattttatcaaaggtttgccagccaataaagtgcatcccaagtatacaggggagaaagctagactcctacagggtcctagagtttaagtaatttttttgttattaatataggtaataatttttctaatttttattttttggttccaaatgtaaagctccttgtgtttacctctgtttatgtcattcttgacatgtttatctaaattatgtgtgctctgtgacaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaagccatagtgttttcatttgtcttttcttcaggatacacggtagaagtcagagaatctttgatacttttatttggtgcaataatcaaggccatgcaacaacccaaaatcaagcattttggttcaagtcaggatgacatgagtggggacagaagctgtggcagtcattcaaataatctcatgggtcctgaggaaaagacaggagttaatgtattaagtttctactatatgcaggaactgtgttaaatattttacataagttttgataatagctaacattagctgagcacaaaatttgggccctgatttgtgctgagtatctttcacagattactgcttttaatcagcagtccttgtgagctaggtatgatcattatccccattttatagattacagatgagattctgaggcacaaagaggctaagtaacttgccaaagatcatacgatgttaagtaatggcccctggattcagtctgcagcctgaattcttaaccaattatactgtgatttcattattcttcagaattacactaaaaagaaggtattattcccattttacagatgaggtatctaagctcagagaagctaaacaacttgtgcaacaatcactaagcttataagcagtggattagggttagatttagatatttgtctggcatccaaacctgtgctctccctacagtaccacatggtttccacagtctcatcagaccccggaatttcactccctgagactgcttaattgtgaatttcccaaactgattcaccaagagcctactgtctctgctttgtagatagctttgaccacattcaatgacattaggaaagactccatttcccaagatggctcagaaaatcagatgctatgacgcatgttgaaagtgaaaacccatctctgagaaagaagcatctgttttattagtaaaaaaaaaaaaatgaaatttacagcaatgttgtgtgacttctcaaaattctttcattttcttatttcagaatgaatagtgttgttcgttggctgggaatggggaagaatgtgatttttaaaaataaagcataatcaaactctgcataaaag

SEQ ID NO: 338509 - DNA, 8257 bp, Homo sapiens
  misc_feature (1)..(2): n is a, c, g, or t
  misc_feature (4)..(4): n is a, c, g, or t
  misc_feature (4236)..(4236): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatccaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacgtgactatgccttctggtcatcctangactatttggagttctccaaaaccttgtaagaggcatgtcaggcatgcagtaaaagcatctacaacttcagctgggcactggcagcataggtctcatcttggaccatacagtcccactttatagaagagagtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcattctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaaaacacctgatctacattgaaagggggtagactaacgtatgtgagaccattttcctatttgcagttacaaggttaaagaactttgaaggtcattcggctgctaagaggcatgtcgaacactctgtgtggctctttcacagtaaaccctcctaagagcagaagacacatggctgttagtgtctgcgtttagatttaatttctcaaataaaggcccttggctgcgtatcatttcatccagttataaactagggctcctgcaagcacccccattctaagggtgaattattgaaatcagttgctatttgatgagtcacaactggcccagcaggcagggcatttgaagtcatggtcatcaaaaagaaatgattgttttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagagaaatttaattttaaatatcaagtcctgtcaaacatttctcaaacttctgattttatcaaaggtttgccagccaataaagtgcatcccaagtatacaggggagaaagctagactcctacagggtcctagagtttaagtaatttttttgttattaatataggtaataatttttctaatttttattttttggttccaaatgtaaagctccttgtgtttacctctgtttatgtcattcttgacatgtttatctaaattatgtgtgctctgtgacaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaagccatagtgttttcatttgtcttttcttcaggatacacggtagaagtcagagaatctttgatacttttatttggtgcaataatcaaggccatgcaacaacccaaaatcaagcattttggttcaagtcaggatgacatgagtggggacagaagctgtggcagtcattcaaataatctcatgggtcctgaggaaaagacaggagttaatgtattaagtttctactatatgcaggaactgtgttaaatattttacataagttttgataatagctaacattagctgagcacaaaatttgggccctgatttgtgctgagtatctttcacagattactgcttttaatcagcagtccttgtgagctaggtatgatcattatccccattttatagattacagatgagattctgaggcacaaagaggctaagtaacttgccaaagatcatacgatgttaagtaatggcccctggattcagtctgcagcctgaattcttaaccaattatactgtgatttcattattcttcagaattacactaaaaagaaggtattattcccattttacagatgaggtatctaagctcagagaagctaaacaacttgtgcaacaatcactaagcttataagcagtggattagggttagatttagatatttgtctggcatccaaacctgtgctctccctacagtaccacatggtttccacagtctcatcagaccccggaatttcactccctgagactgcttaattgtgaatttcccaaactgattcaccaagagcctactgtctctgctttgtagatagctttgaccacattcaatgacattaggaaagactccatttcccaagatggctcagaaaatcagatgctatgacgcatgttgaaagtgaaaacccatctctgagaaagaagcatctgttttattagtaaaaaaaaaaaaatgaaatttacagcaatgttgtgtgacttctcaaaattctttcattttcttatttcagaatgaatagtgttgttcgttggctgggaatggggaagaatgtgatttttaaaaataaagcataatcaaactctgcataaaag

SEQ ID NO: 338510 - DNA, 6855 bp, Homo sapiens
  misc_feature (1)..(2): n is a, c, g, or t
  misc_feature (4)..(4): n is a, c, g, or t
  misc_feature (2834)..(2834): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggatgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatccaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacgtgactatgccttctggtcatcctangactatttggagttctccaaaaccttgtaagaggcatgtcaggcatgcagtaaaagcatctacaacttcagctgggcactggcagcataggtctcatcttggaccatacagtcccactttatagaagagagtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcattctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaaaacacctgatctacattgaaagggggtagactaacgtatgtgagaccattttcctatttgcagttacaaggttaaagaactttgaaggtcattcggctgctaagaggcatgtcgaacactctgtgtggctctttcacagtaaaccctcctaagagcagaagacacatggctgttagtgtctgcgtttagatttaatttctcaaataaaggcccttggctgcgtatcatttcatccagttataaactagggctcctgcaagcacccccattctaagggtgaattattgaaatcagttgctatttgatgagtcacaactggcccagcaggcagggcatttgaagtcatggtcatcaaaaagaaatgattgttttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagagaaatttaattttaaatatcaagtcctgtcaaacatttctcaaacttctgattttatcaaaggtttgccagccaataaagtgcatcccaagtatacaggggagaaagctagactcctacagggtcctagagtttaagtaatttttttgttattaatataggtaataatttttctaatttttattttttggttccaaatgtaaagctccttgtgtttacctctgtttatgtcattcttgacatgtttatctaaattatgtgtgctctgtgacaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaagccatagtgttttcatttgtcttttcttcaggatacacggtagaagtcagagaatctttgatacttttatttggtgcaataatcaaggccatgcaacaacccaaaatcaagcattttggttcaagtcaggatgacatgagtggggacagaagctgtggcagtcattcaaataatctcatgggtcctgaggaaaagacaggagttaatgtattaagtttctactatatgcaggaactgtgttaaatattttacataagttttgataatagctaacattagctgagcacaaaatttgggccctgatttgtgctgagtatctttcacagattactgcttttaatcagcagtccttgtgagctaggtatgatcattatccccattttatagattacagatgagattctgaggcacaaagaggctaagtaacttgccaaagatcatacgatgttaagtaatggcccctggattcagtctgcagcctgaattcttaaccaattatactgtgatttcattattcttcagaattacactaaaaagaaggtattattcccattttacagatgaggtatctaagctcagagaagctaaacaacttgtgcaacaatcactaagcttataagcagtggattagggttagatttagatatttgtctggcatccaaacctgtgctctccctacagtaccacatggtttccacagtctcatcagaccccggaatttcactccctgagactgcttaattgtgaatttcccaaactgattcaccaagagcctactgtctctgctttgtagatagctttgaccacattcaatgacattaggaaagactccatttcccaagatggctcagaaaatcagatgctatgacgcatgttgaaagtgaaaacccatctctgagaaagaagcatctgttttattagtaaaaaaaaaaaaatgaaatttacagcaatgttgtgtgacttctcaaaattctttcattttcttatttcagaatgaatagtgttgttcgttggctgggaatggggaagaatgtgatttttaaaaataaagcataatcaaactctgcataaaag

SEQ ID NO: 338511 - DNA, 4977 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttaaaaaaaaaaaaaacaaaaaaaaaaaaaaaaaaaaaaaaaaaaaaacaaacaaaacaaaaaaaaaaaaaaaaaacaaaccaaaaccaaaaaacaaaaaaaaacaaaaaaaataaaaaaaaaaaaaaaaaaacaaaaaaaaacacacagtcggcgcgcgagaccaacaggatacgagccacacccaaacgcacgcccaagacaaggagcggaggccgcacagacagacgcaaacgtagaccaccgcgcgcccgaagcagcgccaggccacgagcaccggccagacgccagacccaccaactcgcggcgtcggccgtacctcaaccccagaccgaacaacgaagacgaggacgcggccaacacgcacccgcgcccagcaggcaatatgacgaaccaagaagagtgagaacagacaacggagccgcagacggacaccgacaaccgcgacgcacacccgtacgaataagaataataagcacatcgacgaacgcaggtaggcagtgagtcacacacaaacaagacacggtaaagtagacgacccgaccaccacgccaacgaacgacaagcagagcacagaaaaagttacaggagagcacgacagcaactgacctagtcaaagattgataaagaccagcgagaaagtacgaacgacacgcagaagacaaagacacagattgcgagagagccgcgaacagacgcgtagagcggctcgcacccacagtcataatcgacatagcaagtacgagtcgcatgccacgacagaagcaagcgacagtagcaggcagcgaaacagaagacagacag

SEQ ID NO: 338512 - DNA, 3004 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagtt

SEQ ID NO: 338513 - DNA, 1619 bp, Homo sapiens
  misc_feature (1)..(2): n is a, c, g, or t
  misc_feature (4)..(4): n is a, c, g, or t
  misc_feature (1612)..(1612): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttcccattgtttgtttgtatctcctntctaggt

SEQ ID NO: 338514 - DNA, 942 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgaaacacgcgcatgtttcaccacccacgtatgtcgtcgtgaaacaatgcgggtaccgag

SEQ ID NO: 338515 - DNA, 7298 bp, Homo sapiens
  misc_feature (1)..(2): n is a, c, g, or t
  misc_feature (4)..(4): n is a, c, g, or t
  misc_feature (4946)..(4946): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatccaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacgtgactatgccttctggtcatcctangactatttggagttctccaaaaccttgtaagaggcatgtcaggcatgcagtaaaagcatctacaacttcagctgggcactggcagcataggtctcatcttggaccatacagtcccactttatagaagagagtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcattctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaaaacacctgatctacattgaaagggggtagactaacgtatgtgagaccattttcctatttgcagttacaaggttaaagaactttgaaggtcattcggctgctaagaggcatgtcgaacactctgtgtggctctttcacagtaaaccctcctaagagcagaagacacatggctgttagtgtctgcgtttagatttaatttctcaaataaaggcccttggctgcgtatcatttcatccagttataaactagggctcctgcaagcacccccattctaagggtgaattattgaaatcagttgctatttgatgagtcacaactggcccagcaggcagggcatttgaagtcatggtcatcaaaaagaaatgattgttttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagagaaatttaatttta

SEQ ID NO: 338516 - DNA, 3875 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaagccatagtgttttcatttgtcttttcttcaggatacacggtagaagtcagagaatctttgatacttttatttggtgcaataatcaaggccatgcaacaacccaaaatcaagcattttggttcaagtcaggatgacatgagtggggacagaagctgtggcagtcattcaaataatctcatgggtcctgaggaaaagacaggagttaatgtattaagtttctactatatgcaggaactgtgttaaatattttacataagttttgataatagctaacattagctgagcacaaaatttgggccctgatttgtgctgagtatctttcacagattactgcttttaatcagcagtccttgtgagctaggtatgatcattatccccattttatagattacagatgagattctgaggcacaaagaggctaagtaacttgccaaagatcatacgatgttaagtaatggcccctggattcagtctgcagcctgaattcttaaccaattatactgtgatttcattattcttcagaattacactaaaaagaaggtattattcccattttacagatgaggtatctaagctcagagaagctaaacaacttgtgcaacaatcactaagcttataagcagtggattagggttagatttagatatttgtctggcatccaaacctgtgctctccctacagtaccacatggtttccacagtctcatcagaccccggaatttcactccctgagactgcttaattgtgaatttcccaaactgattcaccaagagcctactgtctctgctttgtagatagctttgaccacattcaatgacattaggaaagactccatttcccaagatggctcagaaaatcagatgctatgacgcatgttgaaagtgaaaacccatctctgagaaagaagcatctgttttattagtaaaaaaaaaaaaatgaaatttacagcaatgttgtgtgacttctcaaaattctttcattttcttatttcagaatgaatagtgttgttcgttggctgggaatggggaagaatgtgatttttaaaaataaagcataatcaaactctgcataaaag

SEQ ID NO: 338517 - DNA, 1739 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgctgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcaggaggaggacggtacgagctagtg

SEQ ID NO: 338518 - DNA, 762 bp, Homo sapiens
  misc_feature (1)..(2): n is a, c, g, or t
  misc_feature (4)..(4): n is a, c, g, or t
nnantggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaaggcgccacgcaaagagccccccgatgagccacgcgaccgggccacccaacgtgccccacaaagagccggtaccgagctgattca

SEQ ID NO: 338519 - DNA, 774 bp, Homo sapiens
tagctgggactacaggcgcccaccaccaaacccggctaattttttgtactttcagtagaggtggggtttcaccgtgttagccaggatggtctcgatctcctgaccttgtgatccacccacctcagcctcccaaagtgctgggattacaggcgtgagccactgcgcccggccgagatggagtttttccttgttaggccggtctcgaactcccgacctcaggcaatccgcctgcctcggcctcccaaagtgctgggattacaggcgtgagccaccattcccggccagttacagagattttatggtgaagagggaaattgaattctacattggctggccatctggtgagtgtgatggtgataatagtcttcacaaaagatgaacgaaaggatggctgagcaagggtgaccactcagccaaagtttgacaatagtgatttgtagttgacccatttgatacaagtttctaattccttaactctcttcaacagcttgggaacagagaaaggaaatggaagttgcccagggtcagaagggttacaaggataggggattctagggtaacagggagtatttccatgtaatggcccaccatggagaatccataacagtgatgaaggtctaagacagtagttttccatatgttccttggagccctaaaatttcactgcaatgcctgggggttgggggggcgggtgttgacagccctcctgatttaaccaaggtaaattttacttgtttattaattatgggagttccgtggcatctctcattagaa

SEQ ID NO: 338520 - DNA, 464 bp, Homo sapiens
gaggtatctttctagagaaaaaacagtattagctgggcacagtggctcacacctgtaattccagcactttgggaggccaaggcaggagaatcacctgagctcaggagttagagaccagccagggcaacataggaaaaccctatctccacaaaaataataaaagattagctgggcatgatggtacatgcctgtggtgtcagctactcactgatcacaccactgcactccagcatgggtgacagagcaagaccctgtcagagtggaggggtacagggacggggtaagacagtggggactgaaagagagagagaaataaaggaaggaaggcagggaggaagggggaggggggaggtagggtagaaggaaagaaaggaagggagggaagagaggaagggaaggaagggaaagaaaagaagggagggaaagaggattaaaatgcccattagggctgggcgccgtggctc

SEQ ID NO: 338521 - DNA, 288 bp, Homo sapiens
aacccccacctcccgggttcaagcgattctcctgcctcagccttcccagtagctgggattacaggcaaccgccaccacgcccagctaattttttttatatttttagtagggacagggtttcaccatgttggccaggctggtttcgaactcctgacctcaagtggtccgcccgccttggcctcccaaagtgctaggattataggtgtgaaccaccgcacctggccccagataattttttaatagtctctcgtattactgagttttttcatattatatataaagattctg

SEQ ID NO: 338522 - DNA, 1693 bp, Homo sapiens
gagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccctgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaaaactag

SEQ ID NO: 338523 - DNA, 447 bp, Homo sapiens
ggggagcctgcccttggccccaacccatcctctgcccaggggaggtggccgctttttcctgcctcttcctcaagcccccatccctccctctccggctcccttctcccttgaccctggacatcccctactgcagcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttcc

SEQ ID NO: 338524 - DNA, 514 bp, Homo sapiens
ggggagcctgcccttggccccaacccatcctctgcccaggggaggtggccgctttttcctgcctcttcctcaagcccccatccctccctctccggctcccttctcccttgaccctggacatcccctactgcagcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagctcgcccctgagttgcagctcgcccctgagttgcagctcgcccctgagttagcagctcgcccctgagttagcagctcgcccgctgagtctagcagctcgcgcctgagttagcagctcagcacctgaggttagcagc

SEQ ID NO: 338525 - DNA, 545 bp, Homo sapiens
gagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccctgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccaggcccagggcccgagaggcaggccccgagatacagccccgagagtagtaccacc

SEQ ID NO: 338526 - DNA, 429 bp, Homo sapiens
aggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagctcgcccctgagttgcagctcgcccctgagttgcagctcgcccctgagttagcagctcgcccctgagttagcagctcgcccgctgagtctagcagctcgcgcctgagttagcagctcagcacctgaggttagcagc

SEQ ID NO: 338527 - DNA, 541 bp, Homo sapiens
tgataaaaagttgcagttggcccacagctcacagcctaatgctcacggtccgctgggcccaccaagccagcaggcccccatacagtgcctttgtatgaactggatggggaaaaaaaaaaaaaacatcttttcccctgagccagggtgcatggcttggcatgcaggatatggactggaaatcacacctcaccacttccctcagcttgaagccccttacatggtacatacacacatacatactctctatgttaggaagagaatgtgaaattggggtgctcttttgggaattacacattctgggggctcagcacaggtgttgcaaccaagtagtatgtaaaatatgaggctgggcacagtacctcttgctcagtctttcttgagctaaagagcactggtccaagccaagtgtatacatatgcctaagaccacatccagcccagccaaattgctcaacatgcagatgaacttacggaaatctgttatcagaatctttctctatgaaacagaattattattattattattatttttgaaagagcct

SEQ ID NO: 338528 - DNA, 702 bp, Homo sapiens
ttggaaaatctggctgggcgtggtggctcacgcgtgtaatcccagcactttgggaggctaaggtgggcagatgacgaggtcaagagatggagaccttcctggccaacgtggtgaaacgctgtctgtactaaaaatacaaaaattagctgggcgtgatggcgggcactgtaatcccagctactcgggaggccaaggcagaagaatcgcttgaacccaggaggcagaggtggcagtgagccgagattgcgccactcgcagagcaatctgcgagactcatctctaaaaaaaccaaacaaatgaaaaaaaaaaccaattcattggtttttcacgtattcacagaattctgcagtcatcaaccagtcgattacagaatattttcatcaccttaaaaagaaaccctttagctatcagcccccccaacctcttgtcctcctccagccttaggcagctactaatctatctctctctatttgcttattctagacacttcatataaacagaatcacataatatgtggtcttctgtgattggcttctttcactaagcatgatgtttttggggtccagccacattgtagcatgtatcagaacttcattccttcatatggcttcatattattccattgtgtagatagatgtggcacattttgtttatttatctttttgggtgtttgggttgttttcaccttttggctattatgaa

SEQ ID NO: 338529 - DNA, 149 bp, Homo sapiens
acattagtaattatcaaagagtaatgtggaagcattcctattttagtacattcagcagtattccaaaggacaaaaatataccttagctctaggaataatgggtgtgtacctaataaaaggttatgtttcacaaatcaattctgaaaact

SEQ ID NO: 338530 - DNA, 695 bp, Homo sapiens
aaatgaagaaaagaacagttctttttttcttgggactgcgattacatatggtcctgcaggtggttgatgcactgttcattttgttctttttccctgtttcattttgtgcagttgttcactgatctttacttctgtaatatctaaccttctgctgtcaatccctccctccctccctccttcgttcctttctctctcttctcttcctcttccttttctcttctctttcttgcctgtgcagagcagggctgctccataggcaaagtagcccagcgtatttttcatttcagatactgtatatcccctctagaagtttaatttggattttttttcatgtcttccatttctctcctcatatttattatttcctcttctttcttttttgagatgaggtctcactctctcttccaggctggagtgcactggcatgagatctcagctcactgcaacctccacctcccaggttcaagcgacccttctgcctcagcctcctgagtagctgggattacaagtgtgcaccaccacgcccagctaatttttgtatttttagtagagaccaagtttcaccatattggccaggctggtctcagactcctaacctcaagttatccacccaccttggcctcccaaagtgctgggattacaggcttgagacactgctcctggcccgatcctgtgtctttaaaaaaaaaaaaaaa

SEQ ID NO: 338531 - DNA, 762 bp, Homo sapiens
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagaggtacggaaagatggggatggggtagaggtgacgccacccccatccaagggtgggcaatcggggcagtttggagaggggggtcagccataggggtcctggagactgtagaccaggcatccacaaactgattctataaaggccacctcgtcaatatcttcagctttgtggcactgtgggttctgtctagagctgtgccattgtggcacaaagctgctgcagacagtatgtccatgcgtgggtgtg

SEQ ID NO: 338532 - DNA, 373 bp, Homo sapiens
  misc_feature (336)..(336): n is a, c, g, or t
cttttttttccttccattctctaggacaaatatacgtgtatgttcacttacgcctctcaaggagggaccaatgagcaatggcagtgagcagggtccctcagccagcgggagattctctgtctttgaaaagcagggtccctccagccagcaggagtttctgtccctcacagtcagtgctatgtcttggttgcttttgactttatgaaagaacacatcattttgcttttctgtttgcactgaaaatctgtagagggcaagctgacaagcagtctggtgtgagctggtaatttgtaaaaacatcaatctcaaggcttgttgcaaaaacaaacacagacnacatggaagtgggacctgtccctggagacagcctcgc

SEQ ID NO: 338533 - DNA, 169 bp, Homo sapiens
gcggccgcctactactactactgctcgaattcaagcttctaacgatgtacggggacatgagcctgcagaactgctttcctatgtttacccaggggacctcctttcagatgaactgggaagagatgaaatgttttttcatatttaaataaataagaacattaaaaagcaa

SEQ ID NO: 338534 - DNA, 1069 bp, Homo sapiens
caagtgtgtatagtcgatcctgggtgttatttcagtacgatgggttgcgctgtccctgtcctgacgtggccctattgtccattccacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 338535 - DNA, 1137 bp, Homo sapiens
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaaaaaaaaaaaacacacaccaccccaaaaaacccccggggctctttccgggggcgacaacaaggtcttaaggggcccgggcc

SEQ ID NO: 338536 - DNA, 958 bp, Homo sapiens
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagaactgctttcctatgtttacccaggggacctcctttcagatgaactgggaagagatgaaatgttttttcatatttaaataaataagaacattaaaaagcaa

SEQ ID NO: 338537 - DNA, 1142 bp, Homo sapiens
  misc_feature (665)..(665): n is a, c, g, or t
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaacagagggcagcaattgggaacgggncggggtgggggagtggggagggtggggtgaggggggggagggggggtggagagggaaaacgctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 338538 - DNA, 907 bp, Homo sapiens
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaacctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 338539 - DNA, 1057 bp, Homo sapiens
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 338540 - DNA, 1550 bp, Homo sapiens
ttcctcgtattacacatcacaacgttcattcctttttccgcctatctggggtcgcaatccccccaaggtcccacagcccagcgtttccctcacctttaaccccccctcttcttttacccctcctataggccccttgcaaaaaccggtaccgtaactggcccttcaggtatttttgccccccccctttttttgctttttcttttacatcagtttaattatgtcatccttttcttcataatccagatatttaaaatgcaaagaaattaacttcaatgatatgttcagggactggcactaaaaaaaattttcagactgcaaatgagttatacaaatgaaaatatcaaatggagatccagttatcaaatgaaagcactcaacatattaaaagttcacaagtatttgtattgagcacattacaaaagtcagcttgctaactgttgtgattttaaagaactattgcagaagtctgaagaaaatagatttattagttaacttataaagagattaaagaggctgaaacaagtattaaaaagaaatttgtgcctttattagaacgacccacgcgtacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 338541 - DNA, 1197 bp, Homo sapiens
gcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttctattaataatacgacttgaaaaaaaaaaaattcgggttttgtggtgggggaaaggatgaagggctggctaggtctgcccttgaaagggagtgggccatgggttttgatgggcggagtaagcttgggggagtagaagagagtagagagaatagacaggagggcacggagagaaac

SEQ ID NO: 338542 - DNA, 1506 bp, Homo sapiens
ttcctcgtattacacatcacaacgttcattcctttttccgcctatctggggtcgcaatccccccaaggtcccacagcccagcgtttccctcacctttaaccccccctcttcttttacccctcctataggccccttgcaaaaaccggtaccgtaactggcccttcaggtatttttgccccccccctttttttgctttttcttttacatcagtttaattatgtcatccttttcttcataatccagatatttaaaatgcaaagaaattaacttcaatgatatgttcagggactggcactaaaaaaaattttcagactgcaaatgagttatacaaatgaaaatatcaaatggagatccagttatcaaatgaaagcactcaacatattaaaagttcacaagtatttgtattgagcacattacaaaagtcagcttgctaactgttgtgattttaaagaactattgcagaagtctgaagaaaatagatttattagttaacttataaagagattaaagaggctgaaacaagtattaaaaagaaatttgtgcctttattagaacgacccacgcgtacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcaggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 338543 - DNA, 1286 bp, Homo sapiens
ttcctcgtattacacatcacaacgttcattcctttttccgcctatctggggtcgcaatccccccaaggtcccacagcccagcgtttccctcacctttaaccccccctcttcttttacccctcctataggccccttgcaaaaaccggtaccgtaactggcccttcaggtatttttgccccccccctttttttgctttttcttttacatcagtttaattatgtcatccttttcttcataatccagatatttaaaatgcaaagaaattaacttcaatgatatgttcagggactggcactaaaaaaaattttcagactgcaaatgagttatacaaatgaaaatatcaaatggagatccagttatcaaatgaaagcactcaacatattaaaagttcacaagtatttgtattgagcacattacaaaagtcagcttgctaactgttgtgattttaaagaactattgcagaagtctgaagaaaatagatttattagttaacttataaagagattaaagaggctgaaacaagtattaaaaagaaatttgtgcctttattagaacgacccacgcgtacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagttatctcagccccacaagaaaaaggagatgaccagccccattggacagatggggaaactgaggcctagaagctggggatttacaagatcccaagaactctgccagaggtccctgcgtcaaagctcgagcgggtgtgattccagggaggtcatctgctgaggggtgtcgggagatgctgggaaggggcaggcatgctgtggaactgggccgttcctgcctctcgctctgcctccttgccctgctccccgtctgtaacacctgagctgtacctgggca

SEQ ID NO: 338544 - DNA, 657 bp, Homo sapiens
cccattgcagaggttgcagtgacccgagattgcgccactgtattccaacctgggcaatggggcgagactccgtttcaaagaaaaccaaaaacaaaaaacaaaacaaaaaaagtataggcacatgtgtaggttcggatggaacaataaacactacagagtttcgggggattgtggcagatggatgtgaggcaggactagattgcagctctagacagaccagcatgtggatgcttgtattgtgaattttagctacaaatccactgcaagaacaaaccagtaatcccaagaggacccacagatcctctgaaggaagcagagtgctcctgcaggacccaggagacacccaaatacagtgacttccccaactgcaggagtaggaaagggagaccctcctcttctgaacacacaccaccactggagaactgaaggtctgtttgcaggagaagtttctggctttaccttgagctgagttaagttagagagctgagtgaaatgcaggggtagaggaagcagggcagaaggccctgggagctcactgggtccccaaacagccgattcctgcctggcaccatagtactccatcaggagggtggccagaggagcagggggtaaaaccccccaggcagaagaaatctctagctgaactttataacaatt

SEQ ID NO: 338545 - DNA, 237 bp, Homo sapiens
attcgtaagatgaattttatttaacctctccttaattgctagctgttactattacaatattggtgaagcagagcatattcctccaggtttgaagatttgtagcttaaaaaggctataaaaagctgttcagttcagtagttgattttacgtcttaaactattgtaggactcagcagaacctctgataagcaagagagcttgctacctccaacaaaatcacatctccaggcccaaataa

SEQ ID NO: 338546 - DNA, 620 bp, Homo sapiens
tctcttgggcctctggagggatggcatttgtgctaaggcctgaaggaagggtaggaagcagcaagaagggccttccaggaggaaggaagagaaaatatgaaggtcccaagataaagatgagtgaattccagggcagaagagaaagccagtgtgttagggcctggtgcagaaaggggagcgggataggggcgcggtcagaggtaaggctgagactggaccagtttgggcctgggtgccagggtgagtctttggtcatggtacacggaagggttatctgtttgaagttgcggaggggcatgatgtgatgctctgcgtctaagaattattattttatctgctataaggagaatttttgtagggctaaaagtggaagcagtccttatcaggaaacccaaacatttataactttttggaatttctcactcctgggactggctttagaaagtgatccaaaattgtaagggagatcatcagtgttttggtcagcctggcatttagtccacttgctctggtgatggctgcccaatttcttatttttcttttgagaaatcacatccttccctcacccatctctagtccttagggtgggctgaccctacagatgggtacacacctggcct

SEQ ID NO: 338547 - DNA, 713 bp, Homo sapiens
tacaatcagctcggtaccaacctgaagtgccaaataaagcaattaatggaaattaataagtgagcagtgtggatttaatgagctgcctatgaatactatgacatgcgctcgttttgtcggctccctggcggggcatggggacagatcgcagcacttcaacgtctgtatttataaacatgcattcctggacttcaggcagcgcgcatactccatcattggttctgctgtgagtcctacattcaacggagatgtattttgatctctgttgaagacagagcaatcgacggcattcagtttgcactgcactgatttgggattccagtacattgcccagtccctgttagtctatattgggcagcatgtcccattcaggagctccatttgacatcaccgaacgttctccaatgaaggtgtcaggcagttgaggtccatagaggaatcccagcaacttcctttgagaggctcacggccattctgctgctagactgaaaatgcgtttcctctgatttccttagtgaggaagcattcatttaggagccatttaaactgtgtttttctcaaagaagatgtaagtacatttcctgtttatttctcaacttagattaatttgggccacttccggtgagatttaagaccatcattaagaatgtatgggcagggccatctgcagaactaccccacctcccccatcacctatcccaaggacgtgcctg

SEQ ID NO: 338548 - DNA, 617 bp, Homo sapiens
tacaatcagctcggtaccaacctgaagtgccaaataaagcaattaatggaaattaataagtgagcagtgtggatttaatgagctgcctatgaatactatgacatgcgctcgttttgtcggctccctggcggggcatggggacagatcgcagcacttcaacgtctgtatttataaacatgcattcctggacttcaggcagcgcgcatactccatcattggttctgctgtgagtcctacattcaacggagatgtattttgatctctgttgaagacagagcaatcgacggcattcagtttgcactgcactgatttgggattccagtacattgcccagtccctgttagtctatattgggcagcatgtcccattcaggagctccatttgacatcaccgaacgttctccaatgaaggtgtcaggcagttgaggtccatagaggaatcccagcaacttcctttgagaggctcacggccattctgctgctagactgaaaatgcgtttcctctgatttccttagtgaggaagcattcatttaggagccatttaaactgtgtttttctcaaattaatctaagttgagaaataaacaggaaatgtacttacatcttctttgggaaaaa

SEQ ID NO: 338549 - DNA, 789 bp, Homo sapiens
actccggctcactatagccctgccctgggcagcagggctggctggctagcccagaggaaggaacaacgtacagtgaaaagaaccccagaccaggaaccagggaggctagctccactttctgtgtgacctttggcaagtggcattgcctgacttgtttcctcactcacattcaacttagaattgctgtgcatatactatgtgccgggcaccgtggtgtgtacgttaacaagcattgggtctttaaatcttcccaacaatcctatgcggaattgccccattcccatgtcacagatgagaaagcaggaactcagagaggtgaagtgacttggccaagggcacacagcaaagaaggaatcaggtctgagtccaggactctgagctccgactgaggtgctctgtccccaccatcaggctctaacatctgtctcaggaatggcttggactagaacgagctctcaaatgagagggtgggaaggagagctgcctagtagctaagtccccacctccttgcccctccgtgcatgcattaatttgttcagcaaacatttattgaacctccagggtaccagaatggtgctcgatactagggatacagagttcaataagacagggtcttgatgtcttatgggagaaaccagcgtgtaaatcaattccaattcagtgggggcagaagtgttctcgggtgtctggaaaaccccgggaggggcaaagaagccagcctgggatgcagcaggaagcacccactggcttgggaggtcaacgaatttggagagacaagtaggtgaagaa

SEQ ID NO: 338550 - DNA, 342 bp, Homo sapiens
cctactcaccaagaagacatagctatcctaaatctttatgcaataaacaatagagcttcagaacacatgaagcaaaaactgacagaaataaaatagaaatagttccacatataacagttggaggttgcaatattcctctttcagttattaaaaaaacaggcagacacaacattaccatggatagagaagacctgaaaaacattaagaatcatcttgacagttacagaacactccatccaacaacagaatacttattctgggaatcaccaagatagaacacatagtgtgtcacaaaccaaaccttaaacttaaaatgactgaagtcagccgggcacggtgcct

SEQ ID NO: 338551 - DNA, 686 bp, Homo sapiens
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatgggacgaagagcgcgcatcttctcccatcaggttagactgctgtttttgataacccacaaaggtcaatgtataaaatccgctgatgggagaagactggcgcgtcttgctcccatcagggatttctatacattgacctcttgttggttatcaaaaccgcagtccaacgacgtgtcactatgacgatggttcgtgatgggctgatg

SEQ ID NO: 338552 - DNA, 8808 bp, Homo sapiens
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcagtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcaccgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagagggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcattcagtcagtctctgttgactaaatacgacgaaaattcatactttatgcaggagatttctaaaaatttaatgtttattaatagtttatgaatatcaagatacctcattgaatccctaaatttaaaagcagtccagtaaaaggttaactgtataaagaatctatgactttttgagggaagtgtgatatattaacaaatataaccaattctaaatttgttttagctctaacctcatcaaaccaaaggcacagatttgtgtacaatatacccattgaatgtatatcctgagaaaaattggggccaaagaagcaggaaaatctcaaagctctaatggcagcataaatcaaagaatttcacaggctagtgtttttatccatagccattgctcccttgtcaagtgtctcacaaggacatggaagaatgtgttatgttcatcttgtaatcatagcaaaaagtctgcaaaccccagggtcaagcctgctctgccacagggttggatggtgaccttgggcaagtccctggggctggctaggcctccacttgtccatctgtgaaatgaaaggatcagcctggacagccctctaaactcccttacagctctcagcctaagagcgcagcactgaacagcctcatcattccacttttcatgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttccctttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaacagttgtccagctattgcttaataaaattttgcagatcaaaaaaaatgtgtgcag

SEQ ID NO: 338553 - DNA, 2093 bp, Homo sapiens
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcagtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacaccagtgggctcaggagcccggggagaaaaatacatcactaatggccagttttccatatggtctgcacgggtaaagaaagtctgc

SEQ ID NO: 338554 - DNA, 2395 bp, Homo sapiens
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcagtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaacagttgtccagctattgcttaataaaattttgcagatcaaaaaaaatgtgtgcag

SEQ ID NO: 338555 - DNA, 181 bp, Homo sapiens
ccagttgaaaatacggaaatagattgtgattcttcttttttcttttcttcctaccgcagcacaactatcttgctcaggtcacgtctaatatctggggaaccaaatttaagattgtgggcttggctgctttcctgccaaccaacctcggtgcaggtaaaaatcatgtcctcttctctcattg

SEQ ID NO: 338556 - DNA, 11309 bp, Homo sapiens
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcagtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccagtgacaggagcatctggtgtccctgagaacagcccaccttgtaccgtgaacatccctattgcaccgatccacagctcggctcaggctatgtcccccacgcagagcatagggctggtgcagtccctactggccaatcagaatgtgcagctagatgtcctgaccaaccagacgacagctgtagggacagcagaacatgcaggtgacagtgccacccagtacccagtctccaaccggtactccaatcctggacaggtgattttcggaagcgtggaaatgggccgcatcattcagaacccccctccactgtccctgcctcccccgccgcaggggcccatgcagctgtccacggtgggccatggagaccgagaccacgaacacctgcagaagtcagccaaggccctgcggccaacaccgcagctggcagctgagggggacgcagtggtctttagtgccccccaggaggtccaggtgacgaagataaaccctccacccccgtacccaggaaccatccccgctgcccccaccacagcagcacccccgccccctctgccgcccccacagcccccagtggatgtgtgcttgaagaagggcgacttctccctctaccccacgtcagtgcactaccagacccccctgggctatgagaggatcaccaccttcgacagcagtggcaacgtggaggaggtgtgccggccccgcacccggatgctgtgctcccagaacacctacaccctccccggcccgggtagctctgccaccttgaggctcacggccactgagaagaaggtccctcagccctgcagcagtgccaccctgaaccgcctgaccgtccctcgctactccatccccaccggggacccacccccgtatcctgaaattgccagccagctggcccaggggcggggggctgcccagaggtccgacaatagcctcatccacgctaccctgcggaggaacaaccgtgaggctacgctcaagatggcccagctggccgacagcccgcgggcccccctgcagcccctggccaagtccaagggcgggcccgggggggtggtgacacagctcccagcgcggcccccacctgccctgtacacctgcagtcagtgcagtggcacagggcccagctcacagcccggagcctccctggcccataccgccagcgcctccccgttggcctcccagtcctcctacagcctcctgagcccacccgacagcgcccgcgaccgcaccgactacgtcaactcggccttcacggaggacgaggccctgtcccagcactgtcagcttgagaagcccttgaggcaccctcccctgcctgaagctgctgtcaccctgaaacggccacccccttaccagtgggaccccatgctgggtgaggacgtttgggttcctcaagaaaggacagcacagacttcagggcccaaccccttaaaactgtcctctctgatgctgagtcagggccagcacctggacgtgtcccgactgcccttcatctcccccaagtctcctgccagccccactgccactttccaaacaggctatgggatgggagtgccatatccaggaagctataacaacccccctttgcctggagtgcaggctccctgctctcccaaagatgccctgtccccaacgcagtttgcacaacaggagcctgctgtggtccttcagccgctgtacccacccagcctctcctattgcaccctgccccccatgtacccaggaagcagcacgtgctctagtttacagctgccacctgtcgccttgcatccatggagttcctacagcgcctgcccgcccatgcagaacccccagggcactctccccccaaagccacacttggtggtggagaagccccttgtgtccccaccacctgccgacctccaaagccacttgggcacagaggtgatggtagagactgcagacaacttccaggaagtcctctccctgaccgaaagcccagtcccccagcggacagaaaaatttggaaagaagaaccggaagcgcctggacagccgagcagaagaaggcagcgttcaggccatcactgagggcaaagtgaagaaggaggctaggactttgagtgactttaattccctaatctccagcccacacctggggagagagaagaagaaagtgaagagtcagaaagaccaactgaagtcaaagaagttgaataagacaaacgagttccaggacagctccgagagcgagcctgagctgttcatcagcggggatgagctcatgaaccagagccagggcagcagaaagggctggaaaagcaagcgctccccacgggccgccggcgagctggaggaggccaagtgccggcgggccagtgagaaggaggacgggcggctgggcagccaaggcttcgtgtacgtgatggccaacaagcagccgctgtggaacgaggccacccaggtctaccagctggacttcggggggcgggtgacccaggagtccgccaagaacttccagattgagttagaggggcggcaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcaccgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagagggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcattcagtcagtctctgttgactaaatacgacgaaaattcatactttatgcaggagatttctaaaaatttaatgtttattaatagtttatgaatatcaagatacctcattgaatccctaaatttaaaagcagtccagtaaaaggttaactgtataaagaatctatgactttttgagggaagtgtgatatattaacaaatataaccaattctaaatttgttttagctctaacctcatcaaaccaaaggcacagatttgtgtacaatatacccattgaatgtatatcctgagaaaaattggggccaaagaagcaggaaaatctcaaagctctaatggcagcataaatcaaagaatttcacaggctagtgtttttatccatagccattgctcccttgtcaagtgtctcacaaggacatggaagaatgtgttatgttcatcttgtaatcatagcaaaaagtctgcaaaccccagggtcaagcctgctctgccacagggttggatggtgaccttgggcaagtccctggggctggctaggcctccacttgtccatctgtgaaatgaaaggatcagcctggacagccctctaaactcccttacagctctcagcctaagagcgcagcactgaacagcctcatcattccacttttcatgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttccctttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaacagttgtccagctattgcttaataaaattttgcagatcaaaaaaaatgtgtgcag

SEQ ID NO: 338557 - DNA, 2831 bp, Homo sapiens
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcagtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagccgcataactgtctgtcttagagcattaagaatgatgggctgggtgtggta

SEQ ID NO: 338558 - DNA, 921 bp, Homo sapiens
ggaatacctgaacctgggttatcttatctgaagaaagagtctttgaagatgttagaaaggatcttgaaatgaggagattatcctggattctccaagagagcccccaacttaatgacaagtgtccttataaaagacacacagggccgggcgcagtggctcatgcctgtaatcccagcactttgggagggcaatgcaggaggatcacttgaggccaggagttcgaaaccccttctctacaaaaaatacaaaaatcagccaggcttgatggtgcatgcctgtagtcccagctccttgggaggctgaggtgggagtattgtttgagcctgagaggttgaggctgcagtaagctatgattgcaccactgcaccaaagcaagaccccatttcaaaaaacaacaaacaaaccaaaaacacaccagcaggttctgactgcagcctcagaaagcccccggctttcctgttcagcaagcaggcgccctgcagagtgaaggatgctttcccagagccaccctcaagtgctgctggaggcccagattccttcaaatgacctgggcagccctgccggaatgcagtgtgacaacagaaacaagttggctgcttggggaaaccatgcgggcatccccagggtctgatttggtaaccgcagatattctttgataaattgtagaaccattaggcactggtctgggcagtatgtgtatggatggggaatctgtttatgagaatataaaataaaacgtgcaaacacaggagaagtagaagatacaggtggcaggggtagagtgagaactgaagtcaggactggggagctggaggaggaaatcaggcctgaagaaactttgtggctgaagccagcaaatcttgtatatataggatctccatgaactgtcctaaaatttccaagagaaggagacatccgtca

SEQ ID NO: 338559 - DNA, 347 bp, Homo sapiens
tctgtttttcatttctataattttgtcatttcaaggatgttatataaatggaatcacagggcatataactttctgggattgactttcatttaccataatgcccttgagattcagccaagttgttgcgtgcatcaacagtttgttctttttattgctgaataatattccataatatggatacatcagtgttttaacctgttgaaggacatcaggtcgttccagtttttgtccatcttgaataaagttgtcatgaacattcgaatacaggataagaaactgccaaactgttttccagaatgggtatactattttatttatttatttattgagatggagtctcactttgt

SEQ ID NO: 338560 - DNA, 106 bp, Homo sapiens
cttgcaggccacactaagggttccaggatttcttctaagagcaacaatatgtccttgaagtattgggggtacatgagcatgacattattagagttgcattttcaaa

SEQ ID NO: 338561 - DNA, 673 bp, Homo sapiens
ttgggcaactgatagatgggggtgctgcttactgaaatgggaaggtgagaagagaggtatacgttggagaaagatgagtggattttgtgatgtcagtgaggcatctaacacagacagaaatgagtctggagcttaggtgagagatctgggagaccaatttgagcgtatttggcgaataggagatttaaaaatcctggggatggatgagagtaagaaagcatgaaatataaatgggaaaggggttcaagtctgagccttcaaggatggcagcatatggagatcaggttgaatctaaaagaatcaggagtctaaaagaattggccagaaagttaggaggaaaacacagaaatgcaccaaggaatgcaagtttcaagaggaggagagtgaccagaggtgctgaatgctgccaagagatcgagtaggaagagaatggaaaactgtccgctggagcagttctcaactgggggtgattattgcctcacgaggatgcttggcaatgcctatagacattcttggttgtcaaaacataggaggtgctactggtatctagagtgtagaggccagggatactgctaaaatcctctacagcacagaaagcccctcacaacaaagaattatctggctccagctgggcgcggtggctcacgcctataatcccagcactttgggaggc

SEQ ID NO: 338562 - DNA, 354 bp, Homo sapiens
aggctgggcatggtggctcacacctataatcccagcactttgggaggccatggtgggaggatcatttgagtccaggagtttgaggccagcctaggcaacatagcgagacttcatctccagttaaaaaaaaaattttttttaaagaaacatgtacaagaggttcatcacaactttatttgtaatagcaaaaaattagaaacagtctaaatgtccaccgataggagaatggttgtgtcaaatatgacacatttgtattttttattaccatccagcagtttaaaaataatataggaaatctttatatcccaacatagagcgtcctgtaagacacatagttaaatgtttgttgaagat

SEQ ID NO: 338563 - DNA, 109 bp, Homo sapiens
cctgtgtggaggggaggagttaggagccttccacggggtgaacccctgccttcctggcataccacattccactgaggaggagaagcttggagcgcagcctctcactcat

SEQ ID NO: 338564 - DNA, 168 bp, Homo sapiens
gggggataggcagccaggattttactatgttgcctgggctggtttgaactcaagtgatcctcctgcctcagactcccaagtagttgggactacaggtgtgtgccacctgagctaaaattctattaattttaccaaatttcattaaatctaagatgtctgtgattataa

SEQ ID NO: 338565 - DNA, 280 bp, Homo sapiens
tgggcttaagcgatcctcccacctcagcctctcaaacagttgggactataggcatgtgccaccatgcctggctaatttttgtatttgttgtagagatgaggtttcaccatgttgcccaggctagtctgggctcaagtgatccgcctgcctcagcctcccgaaacactggggattacaggtgtgaaccactgggctggaaatgttaatgttttaacttgttgctgtgtttctatgactaattaattcatttaatgattcagggagccagtctgaaatgtta

SEQ ID NO: 338566 - DNA, 909 bp, Homo sapiens
agcctcccaagtagctgggactacccgtgcatgacaccctatctggcccttgttttttgttgttgttgttgttctttcttttttcacgtggtttcgcacttgtcacccaggctggagtgcaatggtgtgttgtcggctcactgcaacctgtctctcaggttgaagtgattctcgtgtctcagtcttccgagtagctgggattacaggcgtgtgccaccacgcctggctaatttttgtatttttagtaaagacggggcttcactatattggtcaggctggtctcgatttcctgacctcaggtgatctgcccacctcagcctcccaaagtgctgatattacaggcgtgagccaccacgcccggcccgcatccggctttaagatttgtttttcacttgcccgtgggaggatgtacttatctcagatgctagagccgggagaccctcccccccaccacccccatctcctgcaggagctctgatcgcagattggagtgtctgaactctgcatctatggacggtgcttctgtaagccggccgcaactctggagtggcatagtaaagtggcaaaggctttgcctttctggttaaagaccccagcacctccagtgagaccctttcctgtacccccactgatattctttatggaatgttttgtgcgtgagtcagcacatttaatgcccgtgaatagtgacaaaacatcgtttgcagtaccctaatgactgatgatgctgagaatcttttgatgtgcttgttggccgtttgtacatctttggagaaatttctcttcgtgtcttttgtctattttatttttttgggacagagtctcactcctaaccccgggctggagtgcagtggcacgatctccacgcactacaattcttgtacctcagcctcccaagtagctgggatt

SEQ ID NO: 338567 - DNA, 302 bp, Homo sapiens
agcgtactctaccacactagctagacaaccagcgctttaaagaaatggacattatagccaggggtggtggtggatgcctgcaatcccagctacttgggaggctgagacatgagaatcccttgaatccgggaggtgaaggttgcagtgagccaagatcgtgacactgcactccagcctgggcaacagagcaagactctgtctcaaattaaaaaaagaaaagagaagaaaagaaacggacgtgaaaacaaccccaaactgtgccaccttaaaagcagccacttggctgggcgcggtggctcaca

SEQ ID NO: 338568 - DNA, 428 bp, Homo sapiens
agtcagtagaccaacaaacatcaaaattagaactccaggaacttcctatcacagaattttcagatacagactataaaatacatatacatgtttaaagatagaaaaggaattgaaaccacggagaaataacaagacattgttttaacaaacaaaaaagatgtcaggaaaaaggcatagaaatgataaatatcctcattgacattaaaacagaatatacaggatgaaaagtaaattacttatagctgaagagagatgtagtgaacctcaagacagatctgaagaaattaagaatgcagcagttagggagaaagaaatggattatatgaaagagggattaagtggcatggaaggcaaaatgagaaagacccaactcatatctgagctctataaggagacaatagatagaattagccagaatggtaaagaca

SEQ ID NO: 338569 - DNA, 333 bp, Homo sapiens
  misc_feature (314)..(314): n is a, c, g, or t
  misc_feature (322)..(322): n is a, c, g, or t
ccaagacccaaagttaaccacaatacaaaaggagagaagaatggatactatgatcttccttttaaactttcattatagctgactgcagaactgctgggatgactcaatagattatgggaaatggcctaaaagtctactggaaaccagactgaactgtggccacatcttaaaaataacctcttgcctctaattttcttctcccccaatttttttgactaaaaagggttttttgctgtttcgttgttgttgtttcgcaatcaccagtcctaaaatgaagctaaaaatttattttcattttatccttggcggtctanagatccgntagaggtccga

SEQ ID NO: 338570 - DNA, 363 bp, Homo sapiens
aaaaggagagaagaatggatactatgatcttccttttaaactttcattatagctgactgcagaactgctgggatgactcaatagattatgggaaatggcctaaaagtctactggaaaccagactgaactgtggccacatcttaaaaataacctcttgcctctaattttcttctcccccaatttttttgactaaaaagggttttttgctgtttcgttgttgttgtttcgcaatcaccagtcctaaaatgaagctaaaaatttattttcattttatccttggtcattctctagcaccacaatcaagaacattaatgagtctttcctacaataccgaaagttagttaaacaaataccttgtttccc

SEQ ID NO: 338571 - DNA, 744 bp, Homo sapiens
cttgactataaaatattttcagatatttgaatgagaaaacaaaaagccatggttccccactgagagacacagaaagaactcctacagctctgccccctccccacacagaccagccctccttccttgaggacaggactgactaggtctgaacacagcaggtgccccacgcatgagctgaactccactgaactacagccagtcacacagactggagggtctttctgtgggattctcccattcccactgaatccttcccataggcaaaaggtagttccctaaaacaaatgagaacagctggaagggatctgtttactgaatcaagaaaacacttaaatctattaactgaatgaagacaactgaaaaacaaaacattcctgaaggattaaactctgcagaaagaagctggcatttgcccaggacaaggacaggcatcctttacaatgcttatctcagttagaacagccttgtaggtagacagggcagaaggatctctgctgggtcagcctaacaggagcaggaagggtcacctggtgcaaaaacaggggaggaaagtttctgaccagctgatgtgaaagcaaagttggccagaggtcacgtgagggaagtctgctaggatgcctgtctcagtctgtgtagttttgctatgaagaaatatctgaggctgggtatttacttttaaaagaggtgtatctggctcatgggtctgcagactgtacaagcagggtgtcagcatctgcttccaaa

SEQ ID NO: 338572 - DNA, 507 bp, Homo sapiens
ttttaatagcttgataatcattctcaaatgtaagtgcacttagttctgtgcattttatttataggtttaaaaatgttattctgagaagggatccataggcttcaccagacagctaaagggatccatcgcacaaaaaaaggttaagaatctacactttatttaactaagatgcaggtgtaacacagaaggcacaggggataattttcaagagccatctaaggggtacaatgtattgagggaaagagaaggctttaaattactaaccaaaataaggccaagtgcaccagaaaaaaaaaatgcacctgagtcttgggaaggagggatatggatatacagaaagaaggatttgtataaactaggagaggctgattgggggaacagaaagaccaatctaatggaattgaagaaaaaggagagaaatgaacctgtacaaggtctggtcaggtcctgtgctctcaaaaagagaaaaacaatctaggctcctccatgaggaaccaagcagccagt

SEQ ID NO: 338573 - DNA, 2636 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcaggtaagttcagatttttccctccagttggtttaatttctatttcctaaaacattaaaataataatggaatgattgaaataataaacatttttcttattcaagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaaaaaaaaaaaa

SEQ ID NO: 338574 - DNA, 1957 bp, Homo sapiens
agcatcgtgatatcgtcatagctgatctctagagtatcccggttcattcgctacacaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcaggtaagttcagatttttccctccagttggtttaatttctatttcctaaaacattaaaataataatggaatgattgaaataataaacatttttcttattcaagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaaaaaaaaaaaa

SEQ ID NO: 338575 - DNA, 1727 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatgtaagtagcttggtttgtatatagcaagcagctcttcaaaagtagtaggggactgtcccaaacctatctgggccttttaagttcccctaatcttgaatattggcttctgagctagt

SEQ ID NO: 338576 - DNA, 1481 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatggtgagtagaaacggcaattttcgaaacagctcattggtctgttttggttttgtactcagttaagctgttggcgtaaaattttctcactaaattgtttggtgcagtgatgcttaaaccatttgctgggagatggtatgtaattttatctccttgtttctctata

SEQ ID NO: 338577 - DNA, 1065 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagcctgggcgacaaaactggagtcatgactattcggagctctttgaatt

SEQ ID NO: 338578 - DNA, 602 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactggcatcaaagactgggttaaatctgtatgaccttgggttagggaggggattgttaaatacaacaccaatccctaggtgacaatatcaataaattggttgagctggcttcaataaaattaaaaacttttgtgcttcaaaagtaacccttttgaaagtgaaaatgcct

SEQ ID NO: 338579 - DNA, 415 bp, Homo sapiens
caaatattatagctgtagtgatgaaagtgacacttacgaaggaaacgcagtttagtgcctacttttaaaaacattacattgttttcattactaaactgtattctatttacaataaaacatttagaaagtgtagaagagaaggaagaggggagaaataccctgttcagcaactctgttaatgtcttttcgtcttacatattgtttacattgtgggtttcttgtattttagataagctaaatgttactgattccgtcataaataaagtcaccgaaaagtctagacaaaaggaagcagatatgtaagtaatattttaataatatgcatgggtgataaggactaatctagattaagcagcaccttgatcataattcttttacagaggatgttcatttgtatacttaaaccaatcattat

SEQ ID NO: 338580 - DNA, 321 bp, Homo sapiens
catgctagcacagcaaatggagagagcagagcaatcaaaatttataaaacttctattttggtgttcaaagatcgggataaatatgtaagtggagaattcaggtaagttcagatttttccctccagttggtttaatttctatttcctaaaacattaaaataataatggaatgattgaaataataaacatttttcttattcaagatttcgtcatggctattgtaaaggaaaccctaggaaaatggtgaaaacttgggcagaaaaagaaatgaggaacttaatcaggtgactgtctgggatgtgtgtatgtctgtcctatgccc

SEQ ID NO: 338581 - DNA, 460 bp, Homo sapiens
cttctgtgtctctggcccataggtaccacggtggaggcgtgtatatcattgacgtgtctcagtccgtggagcacgaccacccacatgccttggagttcttgagaaaggattgcgccaacgtcaatggtgagtagaaacggcaattttcgaaacagctcattggtctgttttggttttgtactcagttaagctgttggcgtaaaattttctcactaaattgtttggtgcagtgatgcttaaaccatttgctgggagatggtatgtaattttatctccttgtttctctataaggtagttggaataataatatttttcctcataaaagctgtcattaacgtttttccttctgacagatttctttatgaggcacagtgttgctgtcatgactgtgcgggagctctttgaatttgtcacagatccatccattacacatgagaacatggatgcttatctctcaaag

SEQ ID NO: 338582 - DNA, 2535 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaaaaaaaaaaaa

SEQ ID NO: 338583 - DNA, 2391 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagtt

SEQ ID NO: 338584 - DNA, 2501 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacattaaaaaaaaaaaaaaaaaaaaaaaaaaaaaaaaaaaacccgcgcggagcgccacccagaggggcggggcggcggcaaaagagagagagagagagagagagagagggggaagagcggggccaccaaagggagtctcacggcccaccaattagggggaccacaggggggcaaaacatggggggcgccccacaaagggagaggacccacttaaaaacaaagaaaaaccggggagaaacagggcgcccaaagaccgctcgacacacacaccgaaataaaaaacaaaacacggacacacaaccaaaacaaaccccacaaaac

SEQ ID NO: 338585 - DNA, 1196 bp, Homo sapiens
cttcatgcacagtgtctgacattcatctaaagttaccatgcatgccaagaactaggaccaagagaagaagaaaaacagaaaatggaagctgacgtacaagtgatgcagatattggatttttcagacatactttaaaataactatgattattagtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaaaaaaaaaaaa

SEQ ID NO: 338586 - DNA, 757 bp, Homo sapiens
agtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacagctagtgccttagactctggaattcccttctaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaagataaggaggaaagagcaaagtagaacaggtgatggatcccagaagaagaatgc

SEQ ID NO: 338587 - DNA, 991 bp, Homo sapiens
ctttgggcaatgtggagttgccttcaatctgggaaggtctctgtttctttgtgtaaggtgaagctgtggtgctgaatgaagcaggtgtcacatttgggttacatttttaaggttctctaatcggtcaaagtgctgtgtaagtttccaggggcaccgtagaacaaagcaggcttaatggattaatggacatgattgagtgagctgatgggttggtgatttcataggtgtctggctttaagccctgccttgcctttgcagttccacagccattcaggctggtcatctcttcctagggcctctggagttggcctaccttggagagatctccaatgtgccattcctcctgcagccgactctccttatccctacttcctcagtgctgagccagaggagagtaccttttatcacttctgtatcatttatttatttcgggaagggagtgtagtggctgccaggagagggaggcacacatataaattgtggacaaagcctagaaacctaggcattgcccctgctcataggaagtcatatgcatggaacatacgcactggagtgctagttagacagctgggatgatagagcaggggatccaggctgatacatcaggggaacttgcagagagaataggggatccaggatgatagagcaggataaggacagctgtggatggagcaggacgactggataatggagcatggagccaggatgatggaacaagcagccaggatgatggacagggagctgggatgatggagccgggagctgggatgatggagcagagcagctgggatgatggagcagggcagctgggatgaaacagcagggagctggaatgatagagcacggcagttgggatgatggaggagggaagctgggatgatggagcagggaagccgggatgatggagcagggaagccgggatgatggagcagggagccaggatgatggagcagggagcctagatgatggagctggcagctgggatgacaga

SEQ ID NO: 338588 - DNA, 478 bp, Homo sapiens
catgtgacgtgctggctccccctttgccttctgccgtgattgtaagtttcctgaggcctccccagaagtcgagcagacgccagcatcatacactctgtacaggctgtggaaccatgagtcaattaaatctcttttctttataaattaccccgtctcaggtgtttctttatagcaatgcaagaacagactaatgcataatcttatactatgaacattgtagtcaatatattcccttatcagggttgtttacataaattatgagctcaatgaaagataaaaatgtgaggccttttattcaaagattatgggaaaaaagtgtagatataaggcattaaaatataaagttttttgctgtcttctatagtctctctcttgccttgatatgtctttgtttaatttgccacttaatgtttttctaagtaataaaaaattttaaattattagcataaattttaacgctcacctatattattcaata

SEQ ID NO: 338589 - DNA, 317 bp, Homo sapiens
tcatgaagtctcaccaatgtagtccaggtaagctaaaataatagatgaaccctggcaggtaatccatgtagtccagggtatgaacagtgaaaaaaccacatgaaatactttggagagtgctaaccagttaaaagatagcactgttcaagaatattttctgatgaccagaatactgcttgagagatgactgctatagtctttgatgcaataagttagaatgcagttagtcctgtcaaaaagtcctacactttatccatttgtgcatctaccacttccctttcatggaaactctgcaagcaattatccaaacaagctga

SEQ ID NO: 338590 - DNA, 420 bp, Homo sapiens
tgagagggagtctcgcttatcgcccaggctggagttcagtggcgcgatctccgctcactgcaacctccacctcccgggttcatgccattctcctgtctcagcctcccgagtagctgggactacaggcgcctgccactgcgcccggctattttttgtatttttagtagagacggggtttcaccgtgttagccaggatggtctcgatctcctgacctcatgatctgcccgcctcagcctcccaaagtgctgggattacaggcgtgagccaccgcgcccggccggtaagttgattttcaataaagaggccaaggtaactaaatggggaaaagaatcatcatttcaataaatggtgctagaataactagataatcatttgagtaaaaaatgaaccctcacctctacctcacactacacacagtc

SEQ ID NO: 338591 - DNA, 1811 bp, Homo sapiens
caggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggacccgtggagaggttccggccccatcaccccaggagaggggagagcacttgaacacggagcaaagccatgaggtccaaccaggagtaccaccccctcctcttcccaaggagcaaagccatgaggtccaaccaggagcaccacccctctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatttccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaatcacacatggtgattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatcacatcatg

SEQ ID NO: 338592 - DNA, 733 bp, Homo sapiens
gttggctagtcgtgcttggatcatggccgtcgtcctgagagtgtcagttgattgggacaagcacatgtgcgtgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatttccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaatcacacatggtgattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatcacatcatg

SEQ ID NO: 338593 - DNA, 1936 bp, Homo sapiens
caggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggacccgtggagaggttccggccccatcaccccaggagaggggagagcacttgaacacggagcaaagccatgaggtccaaccaggagtaccaccccctcctcttcccaaggagcaaagccatgaggtccaaccaggagcaccacccctctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatttccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagt

SEQ ID NO: 338594 - DNA, 5115 bp, Homo sapiens
gaattccgggagcgggcgggctgcgaggccgcggggcatgcgggaggcggaggggtgggaccgggtggctgcgcccattccacacccgccgaaagcggacactgtcagctgaatcactccccttttaggaggagggagggggaaaaggtgtctagctaatttctgcttaaaaaagcacaggagatcgcgggtcagctttgcagtcgctgccttctcgcgcctgaccatgcacccctgcatcttcctgctgggcacaggcgagcgctttatttctggagctgagggctaaaacttttttcacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggaaaagggtggagtgcaccacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggattgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaa

SEQ ID NO: 338595 - DNA, 1978 bp, Homo sapiens
taggatcccccttcaccttagaagttgtggacagggggcaaccggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggaaaagggtggagtgcaccacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggattgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaa

SEQ ID NO: 338596 - DNA, 2332 bp, Homo sapiens
tgcagaaatctctgctgattgagaccttctgatcgaaatgaaaggaataagatcgttgagactgggaaaagcccatgaaagagggaaaaggactgagcatggtgtgtgtaggggacaagaaagctagggaaaatgaggctggaggaatgggatataatgagaatatggagacaatgggtacacagagccaggaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggaaaagggtggagtgcaccacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggattgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaa

SEQ ID NO: 338597 - DNA, 217 bp, Homo sapiens
aaatcagcatcagtacaaattaaatgattaagcatttgctgttttaactacatatgagagagataacccagttaacttttccttttattggctcgtgccctgggcatctgtcatgttaatgcttttgacctttcttaaagattattaaaggtgaaatttcttgcaggtcagggggatttgtacttgaacaccaccaggtaccttgtggcagcgctgt

SEQ ID NO: 338598 - DNA, 756 bp, Homo sapiens
aggagtgctgagttggcttggacctgtccaacctcgtctggcctcatttaaagggcctctgagtcccccacacaagtgtccccagtgaagccaggctggctttctccctggattgagagcactgggtcattcctgactcaagtggagattcctctgctttctacccatggagacgcggttcagtcccacttagtgcatgaagctttttctgatctctgagatcattctgtctacccatccatccagttgtccatccagctattcatctgttcatctgtttgtccatcaatctatcatccttccatccatccgtccatccatgcatctgtccactcattcatccgacaacagctcccaagcacccatctgtgtcaggtactgtttttatgctgggacatggcaggatcccctggctctcagcctcatctctccctcaaatctctctggttaaggccaacagtcctttgccccagttcagtctgcagttcttccccatcccctatgtctctgcaagaaggttttctttctagtcactctcccctccttggtgtctgagactgccccctctcctcctccttggcttccctttctaccaggcccatgcccaactgctgactcccagatccccaccctgggttctgctctctgtagtctcctaattttctctgcatctgaccctcattgtgcacactcacaactgtccaggggtcttagatccctatttccagcccttacctctcttcttggctccagatt

SEQ ID NO: 338599 - DNA, 464 bp, Homo sapiens
aggagtgctgagttggcttggacctgtccaacctcgtctggcctcatttaaagggcctctgagtcccccacacaagtgtccccagtgaagccaggctggctttctccctggattgagagcactgggtcattcctgactcaagtggagattcctctgctttctacccatggagacgcggttcagtcccacttagtgcatgaagctttttctgatctctgagatcattctgtctacccatccatccagttgtccatccagctattcatctgttcatctgtttgtccatcaatctatcatccttccatccatccgtccatccatgcatctgtccactcattcatccgacaacagctcccaagcacccattaataattcttgcctggtgtaataatgggtacataatgagttccatgtcatccctacctacagccgtccttccgtacgaagggggatgaactcgggta

SEQ ID NO: 338600 - DNA, 102 bp, Homo sapiens
aattttttcaaaacaatcacatacgaaaaaaagagtagagctcatgtttcctgatgcctcctccgtccagccctcttctcactttctgttgcatcctttcca

SEQ ID NO: 338601 - DNA, 455 bp, Homo sapiens
acccaggctggtctcaaactcctaggctcaagcaacctgtccaccttggcctctgaaagtgctgggactgcaggcatgagccaccacgcccagcctgagacgtgttgttctgtgtggattgtggattcagtctttctgttccgcttgatactatttcatcccctcaatttcctcttccactcgagcccctgtaacagattgagaccatccagttctatggtgacaggaagaaactgctctccaatagcgaatgcagttactatccgtaatctattactcagtaattatcttcagataaatgcacagatgatctgttgtgaagtctctcgatgatgtgtgaaccaagggaatggaggcgccgatgcctcctggtgtgagcaggaaccacagggacagggcagtccttctggaaagtggcatgctgctgcctcgtgggtggcaccaataacctccag

SEQ ID NO: 338602 - DNA, 318 bp, Homo sapiens
taggtaacgtgagaaatgactgttactattggaaagaagctagaattattgaataactatagagtttgatggaaaatagatagaatactttaaaggtaactatcaatctatagctttcaagccagaagtgaggtggggaagaggggagaaatatgaaaaactatcaatccaacaaaaggcagaggaggaagaaagagaaaacaaaagcattataagtaaaaatacctaaataaggcagcagaactgaagaaataaactcatatatattactaatcacaaagaaatctaaatggattaaatctacctatttaaagactg

SEQ ID NO: 338603 - DNA, 323 bp, Homo sapiens
tgtaccttaccccaaagcttcccaattcccacttcatatgtcatcatgagagcacctaggtgttatcttaacagccttttgactcaggtgacctttcaagaattcttttgcagagtaaaaggagcaaagacagactcaaccaacttaatcttacatttcaagataagaaaacactctacactccatccatgggtcgactaatgcattttcaagcttcaaatatcaggtgaagtgaacgcttaataatgctttctccaacccagatgtttctgccaagcttcttatctataaactgtcccactcccacggacacctcaaaaaca

SEQ ID NO: 338604 - DNA, 112 bp, Homo sapiens
gacattttaaacctaggcctttggactggaggcagaacgatttctgcaaacctaggtcctgaaggctttggggcttattggctggttctcaacctttttgttttttcttccc

SEQ ID NO: 338605 - DNA, 749 bp, Homo sapiens
atcacttttaattctgtcatctaaaaataaccaccagttacatttataaatttcttccagtaacttttttatatgaacatgtttttaaacttgggtcaatattaaaagaccagaagttgttaaacatcattttaaatccccttatccaggaattagcattgttattcttggccgcagcagaatattattttattccctcaagctttccatggcttgggtctgccctggttttgaacattaggttaggctacagaaagcattctgggtctctggcccatttgtttctttctttgtggagacggggtctggctctgttgctcaggcctgtctggaactcctgggctcaagcgacactccacctcggcctcccgagtggctgggaccactggcgcccgccgccaccgcgccggctccgggcctctctctacgcgtggctccgcaggctccattctccacacagtcgtctaggggggcgccaggagccccgcgacgggccaggccggaagctcagcaagtgcaccaggcggcgaaacggccggctgcgcagggcagccccggacacagccacgccgcggccgcccggcgctcccccgacccagccgaccacgaagccgccctccccctcacaccgcagaacctttctgccttttactacttttcaaagtggacctaggctcctggctcgagcctgaggggatacaagggatcacgaggagcgccatcaccgtgcaaggtcgacagcttccgcc

SEQ ID NO: 338606 - DNA, 314 bp, Homo sapiens
gaattcacagaattgatatagcaggaagttgcttcgcgttggtttttcttaggtatttaaattattactattgacttcaggtcatcaaatacttgacacttcaacaaggtcagtatttttaactgaaaaaaaaagtttggttaagctcatatgattaaatccctatcattttaattttaaacttctttcagtcttgctcataaaataagttaatagaaaacccaactttgttcacttgtttatctgctgaccttccctccactattgtcctgtgaccctgccaaatccccctctacgagaaacacccaagaatg

SEQ ID NO: 338607 - DNA, 243 bp, Homo sapiens
aggatgaaagatgaatacttacctacctactgccaattgcctaccacatatcttggtagcatttgagtcatcagaattctgggtggggattcctccctcaattctggaaaggaatcctgaaccacaccttgacctcacattcctggtggtaggtttggtttaggaaaaaagaatatctaggtgaagttacatttgttttgtgaaggcaagagagacacttcattttatgcaagagatacttca

SEQ ID NO: 338608 - DNA, 887 bp, Homo sapiens
tcaggaggctgaagtgggaggatcttttgagcctggaggtcaagactgcagtgagccgtgattacgccactgtactccagcctgtatgacagagtggacacactgttttgtttgtctcaaacaaaacaaaaacaaaaaaacagattgtccatctaatcctaaaaataattacgtaagtttagttggtgggtgataaatgaagttcttcagactttaaatccagtattcatggtcaggcacagtggctcacacctgtaatctcagcactttgggaggcagacgcaggcagatcacctgaggtctagagttcgagaccagcttggccaacatggcaaaaccccatctctactaaaaatacaaaaattagccaggcacggtgattgccacctgaaatcccagctaccagggaggctgaggcaggagaattgcttggagctgggagatggaggttgcagtaagctgagatcacgccattgcactccagcctgggcaacagagcaagagcgagactccatttcaaaaaaaaaaaaaaaaatccagtattcatgcaggaaaatattttcagttcagtaacatagtcattaagtacctactttatgataggcactatagcaggagctacagacacaaagatgaacaagatctggtttctatcctcaaagtgctcatactccagtaagggggaaataaaatgcaatgtgataagaactattctaaattattcttggcaaggtggaggaaaacttgagagtaaagctgggccattagagttaggtggagttttgccaggcaaaaaagcaatggaagggaagggtattatgtttagaagagacatgagagtatatgaaaggtatcagttctagcttaatgcagactaaaataaactg

SEQ ID NO: 338609 - DNA, 644 bp, Homo sapiens
caagcgaggaggggcttctgggtcatagatagatagagacaaacagttgcattcttttgagtttctgattagcctttccaaaggaagcaatcagatacaaattaatctcagtgaccagagggatgacgttgagttctgtctgttctttgtccatgaggaatttccgtgtggacaaaatgtgagggaggtatgtagctttttaaaaaaatcttggtagctacttttttaaggactagaatgggaggcaggtttgcactaagcagttcccagcttgacttttccctttggcttagtgattttggggtcgcaagatttattttcctttcacacaggaaaggtaaccattctcctcagtgttgctcaagccagaaatttagacgaaggaaacttgaacctttccctgtctttagaattgtaccattacctcagctagttctgtgcattttctaattcgatttttccagcagtgttgtgagtctcttagaacagttattaattaatactttcactttgcagacggggacacttggagaagttgggagaatttttttcataacgaaagatgtaggcagtgtcagtgctgggaaagaatggaaatctattgtttcttacatgttacttaagaaagagaaagaaaaaaccaa

SEQ ID NO: 338610 - DNA, 335 bp, Homo sapiens
tgtgtgtgtgtgtgtgtgtgtgtgtgtgtgtatactaaagtgtctttcagggttttggttttttgattttttttttttttaatggaaggggagagattgtgggaagtggcaccataaatcttaccttgtataaagcactcttttaaaaaattaccttatgttaagcaaaatgttccataaaactctccttttcctgtcttcactgtgtgctttaaaaaacaggtctgtgtaaattctcttgtagttttgttgctactaataatgacattttgtctttttgtgtttaacagtaattgaattcttcccttagttttcacatttctcttaagtagttg

SEQ ID NO: 338611 - DNA, 267 bp, Homo sapiens
ttgggaggctgagatgggaggatctcttgagcccaggagtttgacaatagcctgggcaacaaagggagaccctgtgatatgctatggctctgtgtccccacccaaatctcatctcgatttgtaatcaccacctgtggagggagggaacctgtaatccctcccatgtgttgagtgagggaggtaactggatcatggggagtttcccccatgcggttctcatgctagtgaatgctcacgaaatccaatggttttacaagtgtttgggag

SEQ ID NO: 338612 - DNA, 323 bp, Homo sapiens
cccaccatgattgtgaggcatcgccagccatggggaactgaaaatgcaattaaacctttttttttccacagtttcacgtatgtgtttattagcagtgtgaagacaaactaatacagtaaattggtaacagtaaagtggggtgttgctgaaaagatacccaaaactgtggaagtgactttggaactgggtaacaggcagaggttggaacagtttggagagctgagaagcagacagaaaaatgtggaaaagttaggaacctcctagagacttgctgaatggctttgacaaaaatgcggaaagtgatatgaacaataaggtccagg

SEQ ID NO: 338613 - DNA, 394 bp, Homo sapiens
tgtcttcttgtagggggagaagggagacaagaagcacccagctggtggcacaggccccagaaaggggtggaaatgagacgcatcaggaggcgaggagctgtggactgagatgaaaacacaggactgtttgcaagcctatgtgtcagaagtggttaggcccctggatcccattattcactcatattcactcaagcaaagactcaggtatatctccggagaggcgagccagaggagaactggactccagaatactaggcaaagcttgggagatggtcctagaccaaaagtctacaaactgaacaatgacacccaccatccctttccctgcttgcagccaagcttataattaacaccttcagctggatgcagtgtcatgtctataatcccagcactt

SEQ ID NO: 338614 - DNA, 407 bp, Homo sapiens
  misc_feature (24)..(24): n is a, c, g, or t
ctttcgcttagaatcagaactggngctgggcatgtggctcacgcctgtaattccagcactttgggaggccgaggtgggcggatcatgaggtcaggagtttgagggcagcctggccaacatggtgaaaccgtgtctctacaaaaaaatagaaaaaaaaatccctgcatggtggtgagtacctgtagtcccagttactcaggaggctgaggcatgagaatcgcttgagcctcggaggcggaggctgcagtgagctgagatggtgccactgcactccagcctgggtgacagagctgggtggtggctcaagatatgttttgtaaacctgaagatttgagatcatataagccaaatcgaaacttaactggaattcctaacttttggttctagagactccatgatcaactaag

SEQ ID NO: 338615 - DNA, 418 bp, Homo sapiens
tacacctgagattgatcaacgaatgaggacaggccaagtatggtggctcaggcctgcaatcccaggatcttgggacgccgaagcaggcgaatcacttgacgtcaggagtttgagggcagcctggccaacatggtgaaaccgtgtctctacaaaaaaatagaaaaaaaaatccctgcatggtggtgagtacctgtagtcccagttactcaggaggctgaggcatgagaatcgcttgagcctcggaggcggaggctgcagtgagctgagatggtgccactgcactccagcctgggtgacagagctgggtggtggctcaagatatgttttgtaaacctgaagatttgagatcatataagccaaatcgaaacttaactggaattcctaacttttggttctagagactccatgatcaactaag

SEQ ID NO: 338616 - DNA, 251 bp, Homo sapiens
taatttttatagttttagtagagacggggtttcgccatgttgggcaggctgatatcaaattcctgacctcagaggatccgcccaccttggcctcccaaagtgcggggatcacaggtgtgagtcaccgtgcctggcttatagctatttattgattgactactgatatatgttagtcactgtgctgggataaagtggtggacaagacagatgaagggctggtttgctttctgtgtgggagacagacaacaaac

SEQ ID NO: 338617 - DNA, 548 bp, Homo sapiens
ctgggtgtggggagtggccagcccacaacagagtatgggcaagccaaagcccaggacagagcctggtcttgtgggggcatggagggagcccacccaggagtgcccagtaaacaagaaggagaagccaggtcatcagcccagcaggaaggggagtgaggagtttccagaagaatcctgctgagaggccaaggcataagggtttcacttgagccctcgatcctgacttggtggctccctgggggcactcttagtctgtaaaaggggctaaatgctcaaactatgacctgctacaacaagaaacagtgaggctctgtacacaaagagcttagctcaaggcctggcacatatcgcacactgaaaacattggggactttttgtgtttataaaaatcagtcctacatgctgctactaaagtcattcctccacatacagcaacccaacctgattctgtgaacccagtggatactgtgccagaggctatgggaaaggaggagaagcagttttagcagacaagagtgcagaacccaaaggggtctagtcaaggagac

SEQ ID NO: 338618 - DNA, 420 bp, Homo sapiens
  misc_feature (18)..(18): n is a, c, g, or t
  misc_feature (23)..(23): n is a, c, g, or t
  misc_feature (28)..(29): n is a, c, g, or t
  misc_feature (33)..(33): n is a, c, g, or t
gacggcccgctctagagnatccnctcgnntctngataggaaagtaaataaataaataatgtgtgggactggtaccacaacgtctaggacataggagctctgtattaagggttcctgctttattactttacttattgtcactgcattatacctttgcaaaatatagttttctgtttccaacctaaaaatcctgattaagcaactgaatttgtccttgaagaaaaaataactgctagtaatatcatcagaagccagacccaaaaaggctttataacacctatttaatccttttaaatgaaaatgtatttaaatatataacttcatgtattcatttgaaataagctgctaactctaaatatttaaatattcccaactacactcctgtaaattgtacagagcaaattttattttctacctatca

SEQ ID NO: 338619 - DNA, 1013 bp, Homo sapiens
aagctagtacgaggcctggggtaattcggccgaggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatggggccctggatgggctggttcgcttggtcccatgggatcatgtttcactacacgtgtgggcatctttcaggatgcggggtattctgtcctctgtgtacaagtatagggattccaggtggtaaagtcctacgggcatagataatttgagactcgcgaaaactggtcatatggataaaaacctcggcgccccgcgccgggt

SEQ ID NO: 338620 - DNA, 1985 bp, Homo sapiens
cccacgcgtccgtcgacccacgcgtccggacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338621 - DNA, 1940 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338622 - DNA, 2165 bp, Homo sapiens
  misc_feature (1752)..(1752): n is a, c, g, or t
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaaaaaaaaaaaaaaaaaaaaaaaaaaaaaaaaaaaaaaaaaaaaaaaaaaaaaaagaggggggggggggtaaaaaatccccggggggggccaatgggccccgtttgttgtaaaggggggcccctgggggggcgcgatatataaaaaagagagacgggggcggggggtaacacacaaggctcggtgcggtagggaaaacagcgtataaagcggggacaccatcggtgggaaaaggaccccactgtgggggggcggcaactaagcggggcaacacaccccagaagaaaatagcgcgccgaggcgaaaacaaaacnttgcgggtgttctaggtgtgttacccgaggccatatcttgcggtcgaacaactggctccaggcagagtgttggcaaccattatcgccggcgggcggctggaaactaccgggcggacagaagcagacaaaggaacgacagaggaaacgaacacaagagaagacagccaaggcaatagacagcaggcgcacacgaaccagcacgaagacacagagagaccgagaagaacaaaccaaaaccatcacagaaacgccggaacgcaaaacaacagaaaaacaagaacaagagaagacagaagagcaagccaagaaacaaaagaagcaacacgaacgaaacagcactagcacgccagcacgaccgacgcaagcgagaacgacgacaacaaacacagcacaaaacgaagaagcgagagcaa

SEQ ID NO: 338623 - DNA, 1329 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggagctatcaagtgtggaggccaggagccaatacaagtgtgagaacaggagacaacacaagtgggcggccacgtagacaaccgaatgggagaccaggaggcaacc

SEQ ID NO: 338624 - DNA, 1962 bp, Homo sapiens
ctactatggcttgggactgtttaatgagattggagctattgaaaaggctgtaatttggcctcagtatgtcaaggatagaattcattccaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338625 - DNA, 2008 bp, Homo sapiens
gggaaccccgagcgggctatcgaggcagacctcgccacctgtctggccctcggaccttcagagccgggtgtcgccccccgtgggtagctgtggcaccgtgtgcatgcttgtcgtgcgggcactcatcgagccttgcctcaagtcggtctgtccacccaacacgactcgtgccggcaccgcgtgcctcctcagtggtccggtcgcaccgtaaattcgcctacagcgagaatcaatcacatggacgtcgcggactgagctagtatggagactatgcgcagacgaaaagcgaaggaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338626 - DNA, 2021 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338627 - DNA, 1645 bp, Homo sapiens
gatatcctaccatattgtgacggagtccaaatagaaaacatgcagcaacagttctcctgctttatcagctccctggaaaataaaccagtgcttcctgcttctgcccttcctgcttgcttcctgcttctgcccttcctgcttgcttcctgcttctgcccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338628 - DNA, 1336 bp, Homo sapiens
ctggcctcccacttggttgcctggccacccacttggttgcggcctcccacttggttgcaggaagtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338629 - DNA, 1345 bp, Homo sapiens
agtcacctgattcgtgatacaactctagagatcccggctgcagaggtatatcagtatggggatcaagggcaggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338630 - DNA, 919 bp, Homo sapiens
  misc_feature (857)..(857): n is a, c, g, or t
  misc_feature (860)..(861): n is a, c, g, or t
  misc_feature (873)..(874): n is a, c, g, or t
  misc_feature (887)..(888): n is a, c, g, or t
  misc_feature (893)..(894): n is a, c, g, or t
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgatgggtggcagggggtctcttgacaatatagggggtccttctcatagagggtgggacntgnntggggagccccnngggcctttgcccnnaaatnnacaggggtccccgagggcggccccg

SEQ ID NO: 338631 - DNA, 859 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctgggtagcaatgttgggtcttgaacataggggctcttgcaaaaatgggttacacggctggggagc

SEQ ID NO: 338632 - DNA, 992 bp, Homo sapiens
gctaggagagagaactggatgctggtgtggtgacccgcagtcgtggactgtggtggagctgtcctgcggacgaagatgtcactctcgcccgagaagggggacactgtgatggtgttcttaagctcatagagtggcaggttgtctgaaatgccaccatccacgtagcgcaccccctggagggagggagggatgagcccacagtacacggggatgaaaccgctgcagacattggcctggatgagctcgtcctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338633 - DNA, 603 bp, Homo sapiens
actctagagtatccccatgctcatccctccttgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338634 - DNA, 818 bp, Homo sapiens
  misc_feature (818)..(818): n is a, c, g, or t
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggctcaattttgcgtgaggttccatgggggttctttgccatattagggggcccttctaataaagatgatgn

SEQ ID NO: 338635 - DNA, 2069 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338636 - DNA, 2449 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagttctgtcttaatgaaatatatcaacccaaaagtgtaatgaggaaaatgcttcattagtttcccctagcagacttttacttctcttacactgctacaccattactttcttgagacatttgtaagtcctttgatacagaagagttatatttaggaggctttaatgaaggg

SEQ ID NO: 338637 - DNA, 863 bp, Homo sapiens
  misc_feature (9)..(9): n is a, c, g, or t
  misc_feature (28)..(28): n is a, c, g, or t
  misc_feature (40)..(40): n is a, c, g, or t
  misc_feature (801)..(801): n is a, c, g, or t
  misc_feature (804)..(805): n is a, c, g, or t
  misc_feature (817)..(818): n is a, c, g, or t
  misc_feature (831)..(832): n is a, c, g, or t
  misc_feature (837)..(838): n is a, c, g, or t
tctgaactntttggcacccctactactntgctgcgagacnacgacagaagggggaggacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgatgggtggcagggggtctcttgacaatatagggggtccttctcatagagggtgggacntgnntggggagccccnngggcctttgcccnnaaatnnacaggggtccccgagggcggccccg

SEQ ID NO: 338638 - DNA, 2793 bp, Homo sapiens
  misc_feature (2380)..(2380): n is a, c, g, or t
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgaaaaaaaaaaaaaaaaaaaaaaaaaaaaaaaaaaaaaaaaaaaaaaaaaaaaaagaggggggggggggtaaaaaatccccggggggggccaatgggccccgtttgttgtaaaggggggcccctgggggggcgcgatatataaaaaagagagacgggggcggggggtaacacacaaggctcggtgcggtagggaaaacagcgtataaagcggggacaccatcggtgggaaaaggaccccactgtgggggggcggcaactaagcggggcaacacaccccagaagaaaatagcgcgccgaggcgaaaacaaaacnttgcgggtgttctaggtgtgttacccgaggccatatcttgcggtcgaacaactggctccaggcagagtgttggcaaccattatcgccggcgggcggctggaaactaccgggcggacagaagcagacaaaggaacgacagaggaaacgaacacaagagaagacagccaaggcaatagacagcaggcgcacacgaaccagcacgaagacacagagagaccgagaagaacaaaccaaaaccatcacagaaacgccggaacgcaaaacaacagaaaaacaagaacaagagaagacagaagagcaagccaagaaacaaaagaagcaacacgaacgaaacagcactagcacgccagcacgaccgacgcaagcgagaacgacgacaacaaacacagcacaaaacgaagaagcgagagcaa

SEQ ID NO: 338639 - DNA, 2013 bp, Homo sapiens
  misc_feature (9)..(9): n is a, c, g, or t
  misc_feature (28)..(28): n is a, c, g, or t
  misc_feature (40)..(40): n is a, c, g, or t
tctgaactntttggcacccctactactntgctgcgagacnacgacagaagggggaggacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338640 - DNA, 1452 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaggattactgcatttattctccgtcgacgcggcccgg

SEQ ID NO: 338641 - DNA, 1946 bp, Homo sapiens
aaggctaggtacgaggcctgggtgttgtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338642 - DNA, 1973 bp, Homo sapiens
  misc_feature (8)..(8): n is a, c, g, or t
cgcggccncgcgaacgctgcgaggacgacagaaggggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338643 - DNA, 2005 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338644 - DNA, 1938 bp, Homo sapiens
  misc_feature (8)..(8): n is a, c, g, or t
cgcggccncgcgaacgctgcgaggacgacagaaggggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338645 - DNA, 1519 bp, Homo sapiens
gagaagattagagcgcggtcaccgtttgtaatttcagtaccgggactggattattggtatacagtgtgtcgctttggcagtacacaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338646 - DNA, 1264 bp, Homo sapiens
cccacgcgtccgtcgacccacgcgtccggacgctaggggcccggaagggaaactgcgaggcgaaggtgaccggggaccgaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338647 - DNA, 1120 bp, Homo sapiens
ggctgacctaaggacccgacattggtgtctcagtgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatga

SEQ ID NO: 338648 - DNA, 681 bp, Homo sapiens
agtgtggccgcttttccgacagaggcctgcccgtgattggctgctcgtactatttacgtcctttcgatgttgcgacatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtgtgtaagtaaattgttttaagtaaactgttcctaaacaactccagccttaaaacaaaaattcaaattttcttctcattcctatctttagtcactttggaatgttttgtgtctagtctttgtgtatacacacaaata

SEQ ID NO: 338649 - DNA, 489 bp, Homo sapiens
aaaaatccaagatcagaaaatatttttctctaaatttcttatgtctctctctctctctctcttttcacctgagaacagcacctacagtttccattaaaaaaaaagtcaaatctcaccagctgctggtatttcaggtttttcaagggattgtctaagatttaacactgtcctaacttaagaaggaaaaggaaaaagtaaagagaaaaaatgaacttggtcaacacttcagtacaaatttggcacttgctcaaagatgtagtgtggtgtgcaatagataaagtcctctaaagaaaataattgcttattttgtggtggatagcaaggaagttaaaaacaggctctttttccctctttcccctcatgcacagacttccatctttaaagtagagagatggagaaggtggagagaagtaaagagaaattcatttttcttttttttctgtcaggtgcattacaaagaaaaaaaatgaaaggaaagaaaaagaaaag

SEQ ID NO: 338650 - DNA, 1042 bp, Homo sapiens
cctcattagcagtcagttctcattccgtctcttcccctcttctcaaaccactaatccactttttgtctctgtagatttgcctattttggacatttcatataagtgaaatcatatgatatgtaacattttgaaactggcttctttcattttagtgtgatgttttcaaggttccttcatgctgtaccatgtatcaatacttcattcccttttatggctgaaaaatattccattgtatggatataccacattttattatccattcatcagttgttggacatttgagttgtttctactttttggctattatgaataatgctgttgtgaatatttgtgtgcaaatttttgtgagaatatgtttttatttctcttggtatatacttaatagtgtaattgctgtgtcattttgataaatttatgtttaacttttcaaggaactgttttctaaagtggctgtgctactttacattcccaccagcaatacatatgtgttctagtttttctgcatcctcaccaatacttgttattgtctttttaaagctataggcatcttattgggcgtgtctcttatacttttatccttgagtttaggtaaatgtgacaacacctaagtggacatgttctcttgacttccagaaggatggacactgttaggaccaactagtcttcgtgacagtgcaaaactaagctaaagtttagaaggataagcaaggtgcaaagataaagcagaaataagtctggttctaagactttggaaaattatttacttctttttagttccctaccttttctttaggtctgttcctctttacataatacatgttacatgttcttaaaaagctgtattaaatccaatcatatttcacataaaccagataattgctttttttgttgttgttaatttatttatttttagtttttagagacagagtttcgccacttcgtccaggctggagtgcagtggctattcataggcacagtcattatgcactacagcctcaaactcctggccttgagtggtcctcccatctcagcctcctgagta

SEQ ID NO: 338651 - DNA, 298 bp, Homo sapiens
aaaaggatttggcattgggtgtacagctagaggtggaagatcatgcaaataagaccaacaggtccctccattccccaccagcagcctgcatgtgccatttcacttcacacatctctataatgcttgcggtgctggggtgccgttacctctccagttaaataaatctcaaaccaccgacccagggttttcatagcagtgctgcagccatatatgaggaaatgcaacaaacagtccattagcactgattggatatggatttttggcctggccacctgccacttggtaattttagaatagg

SEQ ID NO: 338652 - DNA, 491 bp, Homo sapiens
catcgagccggtccctgaaatgggcacagaaattcagtacctgcttagacagcatcggtttggctgagctgagggatcataggagtgctttttatggtgttgaatttctttgaaaatttctttagaactctggagcccaggtgccagggtggagtctttgttctcccactttctagttggctgtccttcagcaagttacttaatttctgggcctcaatttcctcatctgcaaatttctgtgcccatttcaaacagaaattttcagggtatgacagctaaagggtgtttttgaagaaaagagtttttgaaggaaagagaaagttctaaaatttatcaggtgatagtcgcacaattttgtgaataaactaaaaaccactgacttgtacactttaagtgaattgtatggtacaggaattatatctcaataaagctgtacactcaccccaccccgccaaattgagatatatttctggcccatatcaggtccgagc

SEQ ID NO: 338653 - DNA, 478 bp, Homo sapiens
catcgagccggtccctgaaatgggcacagaaattcagtacctgcttagacagcatcggtttggctgagctgagggatcataggagtgctttttatggtgttgaatttctttgaaaatttctttagaactctggagcccaggtgccagggtggagtctttgttctcccactttctagttggctgtccttcagcaagttacttaatttctgggcccatttcattgaaatgggcacagaaatttccgcgacaatgatcgttgatggccgcagaagtccaatctgtataagcagagcttgcttggttaatgtcggagggataaacactacgttgctgggtgcgtcagccttccagcctctcgacgcaggtgcgatatgcaaaatattttcggtggtggcgataagtgaagcggcgactggcggaacggaagagaccatcatagttttgtctccaacaattctgactgactcatgccccggag

SEQ ID NO: 338654 - DNA, 609 bp, Homo sapiens
ttgaaatgggcacagaaattattctgtatgacaccataatagtgaatacatgtcattatacatttgtccaaacccacagcatgtacaacaccaagagagaaccctagtgtaaactatggactttaggtgatgatgtgtcaatgtcggctcatcaactgtaacaaacataccactctggtgggggatgctgatgatgagggaggctgtgcctgtgtgggggaaatacatgggaaatttctttagaactctggagcccaggtgccagggtggagtctttgttctcccactttctagttggctgtccttcagcaagttacttaatttctgggcctcaatttcctcatctgcaaatttctgtgcccatttcaaacagaaattttcagggtatgacagctaaagggtgtttttgaagaaaagagtttttgaaggaaagagaaagttctaaaatttatcaggtgatagtcgcacaattttgtgaataaactaaaaaccactgacttgtacactttaagtgaattgtatggtacaggaattatatctcaataaagctgtacactcaccccaccccgccaaattgagatatatttctggcccatatcaggtccgagc

SEQ ID NO: 338655 - DNA, 347 bp, Homo sapiens
ttctatttagttaaaatacacggttggactgagctttgatgttatattgcctgttcagaaagggataagcaatattaaaagtatataaaaaattaaaatagggaagaaaaggaaaagaaactgcttaaactacttcatagaactgcttttagaaatttctggctggatgcggtggctcacacttataatcccagcactttgggaggctgaggcaggcagagtgcttgagcccaggagttcaagtccagcctgggcaacatagtgaaatcccatctctacaaaaatacaaaaagaaaaaaaaccaaaaaaattagctgagtgtagtgacttgtgcctgcagtcccagc

SEQ ID NO: 338656 - DNA, 989 bp, Homo sapiens
atatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctacaattacagttcccaaagacacagttgttcatgttatttaaagttttatccagtattctaggaattttcagcaatactaatattctcatttttaaacacttctctttaccattctctactctctcgtctacactcccggctacgcctcggctcccactactcgtccccccagcatcagtgcttcaacatccaggctgacgtttagccattttggctgctgttctttaatcttcctctagcaggcatgcagtccaaggaatatcaaaattctggttgtattgggaaccaaggtta

SEQ ID NO: 338657 - DNA, 934 bp, Homo sapiens
atatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagttatccagtattctaggaattttcagcaatactaatattctcatttttaaacacttctctttaccattctctactctctcgtctacactcccggctacgcctcggctcccactactcgtccccccagcatcagtgcttcaacatccaggctgacgtttagccattttggctgctgttctttaatcttcctctagcaggcatgcagtccaaggaatatcaaaattctggttgtattgggaaccaaggtta

SEQ ID NO: 338658 - DNA, 330 bp, Homo sapiens
gggaaataagaggccaatgcccacaaaagctatcacataaaataatgcaagatacagccaagacaagaaataaggcctgccaggctagagaatgggtacttcctagcccctcctatgattcaatgtccctccctctcaggcaccagaccatgtgcaaatcaggtgccaggaataattgttagagtgcaaagggcttcagtttcccttttgcaaaatgatacattctcagaggtcattaagtcattcaacaaacttttattgattccaccccccacacccactcctggctgagccagatcctgcctgggtcacgcagacattgatgggcac

SEQ ID NO: 338659 - DNA, 583 bp, Homo sapiens
tcaccccaaacttaatgacttaaaataacaatggtttggctcacagatacgcagtttgtgcagagttctgtgggcccccaggcttctcccctcacccacttcctaaggtcgaccagggatttgcctcgtgttcctagtcttttccacacgaagctgcacctatggctgcattttatgtcgtgacaggaatagaagtcactacggcactcacgctagaggaagcaccatgcactgtagaaatcactacggcactcacgctagaggaaccaccatgcaccgtattctggaataaaacagaaaggaacacacggacattggttcaggacaaaggaagcaacaccaaaggctttgtccagacagccacgtgctgcttccgagctgactgtaaagccagcaggcccagccctcatcctccctcaccccacagagaatggacctcagacctcagacacaagcaggtgtccaaattcccaggagcacacagactgccgggacacccagagcttccgattcaggaggcctgggtagggcctgagaatgtgcttttctagcaagtttccaggtgatgctgaggctgctggtc

SEQ ID NO: 338660 - DNA, 837 bp, Homo sapiens
gcgttacagctgaatccacttagaccccagcacaggtcagacttgttctaggctctggatccatttcctatccttaagcaaaacaaataagaaaccccagtagtaggtcagtattcatcaatgtggttctgatctttcaattgaactagtccctgagctaccaatctacaaactagatttcattcccttgggtatttaaggaccgctcagtcctgtccactaccctacgggacctgagggtaacagccagcccaaaagtgcctacaagactgtgcccactgctgtacccaagcagtggttcgttctcttggtatgcctttggaaaacctgccacctgccaggcaggacaaacatctcacctagctgaacttcttcccagagctgggtctccccgacaagagttttccctaccctggtggcccctcctattctagactcaaagtcactcacgctcaagacctcaggcttctctgactcccacatcgtccctacatcaatcaataactaaactctgctgaatccttcttgcacatgtcttctgcagacactcttctttccttgtcatttgtactaccttctttatccctcatcagtctctgcctgcgtttcaaacagtgcttacaaaaaacagccagattaattagccaaaaatacagctttcatatgtcactgaattgctcaaaaagcatctgaggttctctatatccaataagacaaaatttcactttcctttgctgatattgtgaatttccctacttttgaacctttgctaataccattccttctatctaaaatattttctcttctggttgtggtggcttatgcctgtaatcacag

SEQ ID NO: 338661 - DNA, 847 bp, Homo sapiens
cagggaggcgacaggaaggaggcccagaagctcatgcccttagctgtccagtcaaagccagaaagcctgattcacccacaagggcctcagcttcctcacctgtaaaatgggaacagcacccactttattgctaacacttcctgagggctccacgaagagtagctgtgagtgttgtaattacagaaaataagagtgtgtaagagaggctgtctggtgggctgacaggccacggtcccctctggcaattccagtctctgctcatggttttctgcttgaatttaaactactcccaagtggtctcctaaactacccccaagtggcctctacctcagcttttataaatggccatttcccctcttctagatgatccagtcacgaagctccctgagaaaagacctgggccaaacccaattttcacacttttctttaaggaaaatttcaaatccacccacagagtagataatggtgtgattaactgcaggtgcttaccacccaggtccacggccatcggggaccaccctcgtgtcctccacatgccgctcctttctccttctctctcccactagcttccacgaagcaaatcctatgaaacatgcatttgtgctaaaggggtcagtatttatctctacagaacaagcatgaccacaacactatgatcccacctttgataatttcacaatcttccgtctttgttggagtcatatctggctggaatccacaggtccccttactgacacaatcgtatgctcaaagagttaggatgcttgccctgtttcccattgttggttttgcaaatggcgtccctgtggcgtaagtgcacatacccccaatttctcatgaactagac

SEQ ID NO: 338662 - DNA, 546 bp, Homo sapiens
tttgttctttttgtcatacatgcatttttaatctttatgtagccaaatttaatcttttataacttctggattttaggatgtgttatgcttagaaagaccaaattctttctgaagatcacaaaagaagttcaataatgcttccttctagtgcttttgtgtttttaacatttatattttttattcatctggaatttattttgatgactggggatccagctttatttttaccaactgacttaccattttacaaaagtatcatttgttgaatattgtaattccctcatttattgaagccaaattttacagatgctaaatcaatatagaatgctttcagattatttatttattgtttctatttagttttcttccttggttgattcaagcatatattttggcaaggttacttgactaattttcatctttttctgaagcataagactacattttatgttttaatctaaggtataggaatattcagcttttaaagattttaacaaatttaggcctaggcacagaaaaagttctgggaagatgccaacttaaagc

SEQ ID NO: 338663 - DNA, 131 bp, Homo sapiens
tttctttttgcacttagccatataccatgaatacccttacgtcagtatgtacagatcatcgggagtctccatcattttaaatggccccattaacaccccactgaatgcacataccataaccagtcctctct

SEQ ID NO: 338664 - DNA, 107 bp, Homo sapiens
caccaccaccgactcctggtctctgctatccagcagatagcacccatgaggagcatgctgacccatgaggtcacttgggttaattcaaactaggaatgttaagccca

SEQ ID NO: 338665 - DNA, 535 bp, Homo sapiens
aaaactagaactcaggattgaaaaaaaaatctagttcaaaatatgtaggcaataaagctcaaaatcttttaagtatcagacagtaactaagcacctgctgctatgtcgactgccattaataataagccagtcttccctcttaggtttctacccctccgcctaaacaacaaaaacagctttagtggccattatttcaggaggtcggagcacatgctgcacctgtgagcttcaacctgtgttcttggcttgtacctgccagcagagcaggatccctccaccatctcaccacacaccttctcaacatgaacacggacatgcacataaatctaggacattctgaaagaaggggaaatactcagccatgagaaatcctgtccatacggatgggggatctcacagtaaacaaaggtctagcccataatgactgaaagttcatttgagagttagaaggagaagataaatctttcctatttaggtaaattaggtgagataaaatatttgttagttaacacacaaaggcttcatgaaattctgg

SEQ ID NO: 338666 - DNA, 508 bp, Homo sapiens
cactctagtcaacggcacctactgagacttttattaccaatcactggcgtcatcttctgcagccccagcagtgggttaagagaaataaaaggctaaactcaggactacttgccaacaagcatttaacagcattccttaatgcttcagattaattttcatctccctcaacaccctttttaaagatcagaaacttaacatttttccttgctggacaaacttggcttgaacattgctttcgtcgcagactaaatcaacatacagctattaatgcaccacactccctactttgagtatgggtgccaccaaggttctctccaacctttggaattctacgcagtcatagctaagtagctagtttggtttggataaaagctactttaaaatctcaggggcctatgcttgccaaaatcaagttgaaaaatgttggtgtcaaacaattgggaagtatttttctaaaaataacaccctgagaatctgaggcagatatatttgcctctggactagagtg

SEQ ID NO: 338667 - DNA, 572 bp, Homo sapiens
aacagcttgcaaactaaattttaggggcagacaacaggaggtggggaactggttactttcttgccctttaaaaataattaatattttttaaaggcttctgttgtagtaactgtcaattttagaaatattacttgataacatgtctcccaaatctgacttgctacacttttttttggagactgggtctggctctactgccaaggcctgagcagtagcacaatcagagttcgactgcagccttcacttcccaggctcaagccatcctcccgcctcagccttttgcagagcagggacaacaggggcacgctaacacatccagataagctcactttttttgttgttgaggcagggtctcagtatgttgcccaggctgggtgcggtggcgtgtgcctgtaatcccagctactcgggagaaagccagtctagacaaggagctgatggcccagaagctggtgcaggctgagcgggaggcccaggcctctctgcgggagcagcgggcagctcacgaggaggactttacagcgactccagcgtgaaaaggaggcagcatggcgggagctggaggtagcact

SEQ ID NO: 338668 - DNA, 223 bp, Homo sapiens
atctgtaagggaattttaataccaagtagaaaagatggctgggaagtcctttctaataatggactcagactcaataggaaaatagagatgtcctgcttgttcttttgtggagggtcaaaggacatgtacccttgctgcaagaatagaagatgtagctgtggatcaataagaatgctcatattctgtgataataaagttcatggagggctgcttcctgtccata

SEQ ID NO: 338669 - DNA, 396 bp, Homo sapiens
gccagactgcaagatggtccccaatgatcttcaccttcctggtattcatgcccctgtgtagtcctgtcccatactgaataggatattgtggaaatgacaagactgtgactttttttttctttgagatggagtctcactttgtcacccaggctggagtgcagtagcatgatctcggctcactgcaacctccgcctcctgggttcaagcaattctcccacctcagcctcccgagtagctgggattacaggtgcatgccaccatacctggctaattttttgtatctttagtggaaatggggggtctcaccatattggccaggctggtcttgaactcctgacctcaagtgatccacctgccttggcctcccaaagtgctgggattacaggtgtgagccac

SEQ ID NO: 338670 - DNA, 212 bp, Homo sapiens
gtattgcaggtactttggattttattctgagtgagatatgaaggcagtagagggttttgaagaggagtgacgcaatccttatttttgtaaaagatgactctggagtagctgttaagaacgaagagaaggtagttgaagggagaaacagaaaattcaacaataataaatgaagacttcaatactctgctttctctctctctctcttttttttt

SEQ ID NO: 338671 - DNA, 546 bp, Homo sapiens
caacacaatctcctggaggattttgaaacatattatgactcaactcaagtgggaccggggcactgactttgtcaggagctccccgggcaattccagtgtgcagccaggttgggaactgctgactgtgcaaaatgctaaggaggtgggtgggaggagggccacggggaacaaagacacttgggagagatgcataaaggaggaagagaataccaacggtcagcctcagagatgcacccatctgttaacagagaaaggcaacttagaaagacatcagctctgcagggagagaaacagatccattttcaatgtgtcagtattagtgacagctggaactgtggtggctgcaaaaagactaagtgatcagaggccctacagacacagctgtaggaacactaggcagagaggtattggttgaaaccaagggatcacgtcagagagcttggagagctctgtgtgagtacccagaactgagcctgggagacgccagtcatataagggcaggaaaaattagggagtgggaggaaggagaggcaggaggcaggaaga

SEQ ID NO: 338672 - DNA, 326 bp, Homo sapiens
gacttttatgaaaggtgcagcaaaatggattccatcctggaccaaccacactagctcagtgtaaacagaagacacagccatcctggaccagccacactagctccatgtaaacagaagacacagcaagaattagctgctgcatattaacgacctgaaaaaggcactttagagacacataatctcatcttgactgaggttctcctagagaaaacaatccactttacatctgtgtcctcaaagaacagcacttatactagaaaaagcgcaggatgcctctgagaagcgcggtgagttcagaagtctgggcgtcatgtcctctcatcctg

SEQ ID NO: 338673 - DNA, 396 bp, Homo sapiens
gggggactccccaaagcacctgacatgcctgttttgctctttgatccgtgtggttcatagatcactcattgaggggattcaaaattaggggcttgggtgacagtcgccaactgtttggccaggtggacagtatcagcctgatggccagctggccagtgtacaccacctgtctctgtgctgtggtggtggcggcacctgtggggtttctagatcttttctcacgttctactcatttcccctgaagttctaaaattcatattgacgatcttgctgtatgtttgtgttacacatagcaccctgacaagctgaaccatcgccattacccggccctggtccaggttgatgcctgggctttccttatggcacacagctgctgtcagtctgtcattctgcagg

SEQ ID NO: 338674 - DNA, 2093 bp, Homo sapiens
tggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 338675 - DNA, 598 bp, Homo sapiens
acccttgtccatcaatcactgagacatctttttaatgtaactcttctttctctccctgcagactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 338676 - DNA, 1676 bp, Homo sapiens
tggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 338677 - DNA, 391 bp, Homo sapiens
tcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagtaagtcaggatgaggagggtcagtgtgacttctctcctgctgtatttccaagggcccgccccattactcagtctatattgtagg

SEQ ID NO: 338678 - DNA, 397 bp, Homo sapiens
acattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 338679 - DNA, 2171 bp, Homo sapiens
tggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 338680 - DNA, 157 bp, Homo sapiens
ctcactgaccttcctttacctctcatttctttagtttacttatattctcttccttttcataggagccatattttcttgtatccctttaaggatgttaaaagtttcctacattttaatctgatccttaaggtagcttctgcccaaagtactgggtctt

SEQ ID NO: 338681 - DNA, 1085 bp, Homo sapiens
ttgtcctgggttttaaacttggtgaagcaggtttcattcattgagatagaaaacacagaaggagtatgctggattgaagttggggaagtgatgttttgaacttgtcgagttaaagacatttggaacacatgtcagataagatttcaaggctggagatgcagatttacaatggaatcaatggcatataggtggtagtagaagaaaacagaagatgagctgccacagggcaaacgtgcagaatgagcagagggctgagggctgaactgtaggggaggctaaggtttgagaggaagggaggacagtaaagagaagtccaaatatagagcagctggacaagaaagaaaatgaggagaaatggataactcagaaaacaggtgggcaacattttaaggagcagagagtggtcaagaacaccaaatgttgtgcaaagttcaagaaatgaaagagaatcctagataatggacctggtggtcattaggagaggacaggagtgcagggggttgaagatgaaaggaagatggcgaggtgcgggatgtgtacgaggacctgtacttcaaggagctgcctgctaagaccaggaataagatgaaacacacccaaacctagagagaagcgaccaaaagcgttcatcgttttctgttttcataaagaatatgaaagacttatgcatgtttatatgttgaaagaaaaggatcattgagaccctgaagaaaagacaatgaagcaaggtccgtgaggaagcaagagggattagcatcagactggaataagggaaaggaagacaaggagtgggaagagagcctgccatttataagggacacagattaccactgcaaaacatttttccttaattagaaatataaatgtaataatagttatccgtgaaggctttctctctctttaatagtactacttatcatgtataaaataaaataaatgctgagcatgggaagaagtcactagagctccagatctgtggtcttggtagattaccaagcctttcacacaccttcaaactgctcctaaatatcacttcaggtgatactcatcacctgcagagccacaggcgttgctgacagctctga

SEQ ID NO: 338682 - DNA, 378 bp, Homo sapiens
agctataaaatgttatttttcagagtgaagtatctgtcaagatggctagttttggtgtataatagaaatggtattttattccttttatttctgtaaacagattaagtctgtgtgtgtgtgtgtgtgtgtgtgtgtgtgtgtgtgtgtgtgtgtacatgggatataatacaaatctacctcgacttataatgagttacatcctgataaccacaggccaagatgtgttatgatggatctggatatactcataagttgaaaatattttaggtaaaaaatgcatttagtacatttaacaaaaatagtggcaaaccgagtccagcagcacatcaaaaagcttatccaccaagatcaagttggcttcatccatgggatgcaaga

SEQ ID NO: 338683 - DNA, 267 bp, Homo sapiens
agagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtga

SEQ ID NO: 338684 - DNA, 362 bp, Homo sapiens
cacttctccatcttcatctccctcgacgcctcctctcactggcaacacagcagccacttgggtcgtaggcaaccagcagccacctcacctgtcccacctcaaagcctttggccttgcagtttcctctgcctggatttccctgccccccatctctgccctgctggcttgccttctgcctcaagtctccactgaaatgccacctcctctgagaagccttccatgctcctccaggcccattacgtccatcttaatcccttgtttctttcttggcatatatcataggcttatttgtgatactcagcgttttatttgtctgtttgcctgcagaatgtcagtctctaccaccaggatgtgatgtcagg

SEQ ID NO: 338685 - DNA, 604 bp, Homo sapiens
atgagatgtcggttcaatgactattcccttccattccctttcccgtcagtctacacatttttggttcttcaacttctttccaaccttactagaaagtaagcttcatgaaaacatagactttattttgttcaccaccatggccccagcacctagaagagcaaaggtcacataaaatgaaagggtaaatgaatgaatgaatagaatgagataagagcacgtcaagaaataaaatttattaggctcttcccacctgtttcttgatatttttatgctttcattcatttcctatacttttccatttatttgccaaatccaagctgtttcatttataaatatttttccaagtttgttagtatttaccttctattccttatctttgaattaccttttcttttctgtccactaattctgttgctttcaactgtttcaaccttacagtttcgaaccacaaggaatccgattattttttgtatgtgctcctcaaatccataaatctaattttaaattcaaaaacaaacagctctactttctttgaaatgtataaccctataaaatattcacattagtctaaattatatgattaatgtggcatcttccccatgaa

SEQ ID NO: 338686 - DNA, 360 bp, Homo sapiens
catccaatattaacacagaatttccatggtttacaatagcagtggtaatcccaaatcatcctgtgaatgtctcccggaatgactccatagccacacagaaccacatatggctttagatatccatggccctattccacttctgtgctgcaccagctgagacctcagctgtagcaaccctcctctgtccacctaatgccgtttaaagcccagcccctggatttgtgaaccaaaccacatctactatcacagatgagcatatttttcactgcccatatgcaccaggctgaatgaaactccccaggcagcaatgtgctattgaaacttctaaaactaggtgctattgaaacttctaaaactagg

SEQ ID NO: 338687 - DNA, 868 bp, Homo sapiens
tctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggtttggtggcagccgtggtggtggtggatatggtggcagggggatggctataatggatttggtaatgatggaggtggtggaagctacaatgattttgtcaattacaacaatcagtcttcacattttggacccatgaagggaggaaactttggaggcagaagctctggcc

SEQ ID NO: 338688 - DNA, 367 bp, Homo sapiens
tttagtttcttgaaatgcatgcacttaactcccatttaagaagtctcacctggggagacaactgtcttgcgagtcctcctgtggtttgagctacagaaagaaaattctctttcaagtacaagtgcttttacagtaaagcactgcgaattttactgggacctaactaaccagggacaaggaagggaacagctggaatgaatgtggttttcttgaatggagtcagttcaccattaaccaaagtcaatttcacaatcagctgagctgccccctcaccaaggttaaaaaaccagcaagctctgtacatagacatgaagagtaacaagaattcagtcggtacatttcttctgcaaatctctgtgaatggagt

SEQ ID NO: 338689 - DNA, 334 bp, Homo sapiens
caatggagaaaagccaccagcagcagaatttgactgaattagaagacttacttcatctcacagagcttgtcactggaggtggaaaaagaagcatctttcctgccataggccttgtggtctttaatctgcctcatttcaacaggcagcaccagggtcgtggctgcattaaaatactcaggttgtaggaaatgaaaatgcgaacatcactcggcaagtgaaaaaccgaggtgctgataaagtgacctacatagggtcacacatttagttagcaacatatctgggatggaaacctagggctcttgagttctaatcctaatgattatctcaccattag

SEQ ID NO: 338690 - DNA, 608 bp, Homo sapiens
tgacctccagtgttggaggtgagacctggtagaaggtgactggatcctggaggcagatccctcatgaatggcttagtgtcatccctccccctggtgatgagtgagttcccgctcagtcagttccaacaagatctggtcgcttaagagtctgggagcctcccccttctctgtctcttgctactgctcctgctttgccttccaccatgactgtagcttcctgaggcctcccaaggagcagatgccagcaccatgcttcctgtacagtctggagaaccgtgagccaattaagcctcttttctatataaatcatccagccctgggcatttctttatattgacacaaaagcagactaacacaatcaccaagggatgggggagagagtggggtcaggaacagtctggggtctggtcagcgagcagagcctgtgggtcaggaacagtctggggtctggtcagcgagcagggcctgttggcgtcagcagatggtaccgtcgcttcaagagcaggctcagaggcgaggctggaggcagacagaggggagatccagggaggaggcaccgcaagcctcactgccacagtctggtctgcctccctggtggggcaatgctg

SEQ ID NO: 338691 - DNA, 132 bp, Homo sapiens
tcacctaaggcaagtctgttcaacccacagcctgagggccacatgcagccctgaacagctttgcatgtgactcaacacaaattcgtaaacttccttaagacattgtgaaatttttttgtgattttgtttttt

SEQ ID NO: 338692 - DNA, 294 bp, Homo sapiens
ccctctgccagccggttttctgcatgaccttgggcaggtccctgtatctttgggctcaaacgttgtcatcgtgccagtgctcaacagcataatttatgttggattaaatgctagctctgaaaaccacaactcttctatccactgtaggccaatttggggaggaggctgaagggccaggctttcttggcaggcagcggccccacgtttgctgcaccggcctgccgagagtgaggccgtgcagagcctgcccacacagcccccggccccagccatgcccacgcgctgcctagccag

SEQ ID NO: 338693 - DNA, 187 bp, Homo sapiens
tcattcatttaatgcaaattattgtagctactgacacaaatgtattcactttctacctgattatataggaataccctaattatctatattcacatcttattgaacttataaagtgttaggagaccagtgtctgagaaaaaaagtcaaatataaatagattcatctctgagttgtaagaaccttttgt

SEQ ID NO: 338694 - DNA, 643 bp, Homo sapiens
tgccaggctgcctgatgatgtgtggcttgtgctttggatcgtaatgcttacctatgctacttaagttacataccctgtggcctttgtggccaggactgtgggctactacctggagtgattcgttaggggaaaggacccacagcctgtgcaggaggaaaaaagcatctctgagtacagggtggatgagctggatgagctgccgggcaagagccacgcacacccaggtggtgagtcttaaggataaggtggaatttgccccatagctgtcctggacagaaactgcccagagaagaatgaatggaggacatagggctctgtggtcccaccatacatggggagacctgtgactggtcctgttaccatgtcaacttagccccaaacccatctctgattgacttggttgcttattttggcacattcttgctccacacagccacatacatactggctgctcctcgaaggccaggcagatgcagcagctgttgggccagcaaagaggaaggtcctggaaggttctggcctgaacgctgcatctgttgtgtgacagccacaactgctcaggcttccttgtctgtgggtgcactgtggggaggagtgttatgataagaacattggctctcagtctccctggggagaagtttgg

SEQ ID NO: 338695 - DNA, 219 bp, Homo sapiens
atggcaccactgcactccagcctgggcgacagagtgagactctatctcaaagaaaaaaaaaaagtcacaggcatctcaaagaagttcattaagaaagggctcatgtggatcattgatttatttttattatcttaatgtgctaattgctatatataatgcctaaaaagaatagataaacatatgcagaagaattaatttggacccctgcctcacatcata

SEQ ID NO: 338696 - DNA, 657 bp, Homo sapiens
ataattttacccaaatgaatcgcagatggttcttcaatattggatcaatttttgtagaaagagaagttacttggaaaatgggaacaaaatgtcccaatgagaagagaaggttgactgtggaataaattaattttaccagtatatatacacttaattatgaacaagagaatcagaacaaggttcctgctattagagtcaattggtttatcaaattagagtttgaataatgttcttaaattttggcatagattagaatcacgcaggaaggctggttaaaaatgtagattcctgggcactacaactattatgtttcagtaaaggtctggtgtagggcctaggggtatggattttagccagcttcctagtaaattccaaagcctgtcgtctctgtaaaatcaaagcatgctgaaaggcaatatggttaaacgtccatgacaccatcgtttcataatgagattaggaataagtctatgccatttccttattatacagagatagcctccttacaaatatcatctggaacctttatcttctgctttcctgaggtcattttcaagaacatcttccatttatttctcaaccaaccagattttcatagttgcttactccgtaaaggaaaaatgcatatgtgtatgtgtgtgtgcatgtgtgtaaatg

SEQ ID NO: 338697 - DNA, 280 bp, Homo sapiens
aggttgcagtgagccgagatcacacctctgcactccagcctgggcaacgaggggagaccctgtctggaagaaaaaaaaaggcaaaacaatgattaaatagcagttacaaatttaagccttaaatttagcctggaaaaacaaacaaaaaacacctatcaaaaatccaaaagatcaacacctttctcttggcttaaaatactaaattaaaaaaagcctagctgctatgcactgcctttgtaaaaacagcactaaagtgtacctcgtgttcacagcagcagct

SEQ ID NO: 338698 - DNA, 316 bp, Homo sapiens
agcgttgtggatcctagtatttcttgccaaaaagccacaaaagtgtccacaagtctcctggcatatcccaacccccagacaatgaatctgcagcagcaacctgttttctccaccagcctagggtcctggactacctgttcataatcttctctgcctgcatggacccagaaataaatcagagtacagcgccacctgggccactgtctgtagaacaaacaatccacttacactgcattcttccccacccatggattttctttttctacacgtgtacatgtgcagggttgttatatgggtaaaattgtgtcatgggggt

SEQ ID NO: 338699 - DNA, 636 bp, Homo sapiens
acaggaagagccacaagaagtattttactaggaaaagtgcctaaactaacgttctctggccttaaagggtgccagttgagccaggaaacctgacagaaacaaatgcaaacatgtctctgggctgatgctctgtttgtagaaaacccaacatatcctgcattgctctgcattcacagtacgcaggaatcaagtcaaagaaaaaagatgaccactaccctatacttcttaactcaggaactagaccatatgagcactaacagacacacaggcagaaacaataaatatgctattcaatggttgactctgaacaggagaatctgtaaggaatggaaggaagaagactgctattcaactgtcaactgcaaaccaagcccttgatatgctcaaaacccaaatatttaagactgacacatgtccacagtaccaagtgcctcaaaacatctagttaaaaaaaaaaaacaagtacaaaaccccaaaccaaacacagcccaagagagaattcaaatgggtaatgcaaatatccaaaggcttccaaaccagaattgaaacctggttatctaatgtatgagtatgccatgttttcaacactacaccactctatccaagtacacaggaagagccacaagaagtatttta

SEQ ID NO: 338700 - DNA, 625 bp, Homo sapiens
acaggaagagccacaagaagtattttactaggaaaagtgcctaaactaacgttctctggccttaaagggtgccagttgagccaggaaacctgacagaaacaaatgcaaacatgtctctgggctgatgctctgtttgtagaaaacccaacatatcctgcattgctctgcattcacagtacgcaggaatcaagtcaaagaaaaaagatgaccactaccctatacttcttaactcaggaactagaccatatgagcactaacagacacacaggcagaaacaataaatatgctattcaatggttgactctgaacaggagaatctgtaaggaatggaaggaagaagactgctattcaactgtcaactgcaaaccaagcccttgatatgctcaaaacccaaatatttaagactgacacatgtccacagtaccaagtgcctcaaaacatctagttaaaaaaaaaaaacaagtacaaaaccccaaaccaaacacagcccaagagagaattcaaatgggtaatgcaaatatccaaaggcttccaaaccagaattgaaacctggttatctaatgtatgagtatgccatgttttcaacactacaccactccaacatggggcttactaggctacgcat

SEQ ID NO: 338701 - DNA, 490 bp, Homo sapiens
caagcaaagagacagaaaatgatttttaaaataaggccgccaggagacctcaagatcacagcagggtgtggatgctgagtatggaggtcagagccccatcaccctcactagacctgagatgggattctcacggagaggggttccatcccagggaggctgcggggacatcaaagtaaccaggaggtcttgaaaggtgtccaagaggagaagacagaagagctcctgatcagtgctgaggagtgagtgggcaggaaagaaagaagtgatcgcttgaggtcaaggggagctttatttagaatggatgaaacctgaggatgttttcaacacaaggagaagccaggagaagagcagagtggaaaataagacaaacgggagagaatggtgtaggtagagagcgggaaggggtggcatgaaaagcctagaggaacagaggagccttgaaagactccttctcctcctcggaagcccccttcgagtcccgcaccccagc

SEQ ID NO: 338702 - DNA, 867 bp, Homo sapiens
tgagacactcagtgtatatatatgtacatttgagtgactttttgtaagttttattgcaatactaatctagctagttacccacataaagttttagggagcctggtatgtactgccactgggccttggaccccatttttcccagggctcagggctcacctctgtacccagttgtcacagtaagttctttacctttattaatcaggttgattctactcttattgatagtgtaccctcttacacagctgtggttcttgccatctttaactctaatgcccttggctcaggtttccagttgcctatgtgtgtagcagagcagtcattgctactgatagtgtacccaagcagtaggactatgctgagaaggaaaactaaagtgagagatggaaccttgctatttaatatctaacctgctgttagcaggaagcttattgttgtaccctaccaaggaagtgagatagtactaaaataaatcatgggattacctcttgaatgcattgaatggccatgtgttgtcatctggttctatgtttcttctagtggaaggtgctgctttacttatttattactgtttttaccaataagaatgaaaatgggattgtgcaagttcccttgatttcaactaaacatgccatagtgatcatattttaatttatttcaggatatctaaagtcttaactagatttaaacttactgtcaaatgcccgttgtcagttcagtactggtagaaccttgcgtctgttccttatgttcttgttgacagtgcttaaatgcatcattagtacattgtgtacctgaatcatagatgtagttggcattctatgaaaaatggttaaagaaactcaggttattttggttttgcagcagtga

SEQ ID NO: 338703 - DNA, 341 bp, Homo sapiens
ccagttgggattccaaaggaagaaacacttaatgccagggtggtcagtccaaagcatttgttagggagcttatatacagagggggctgcagcgtgccctcacgagggacagccaggaaagaggttgtgcctaggcacaccgcactgagggggtggggtgtggagtttctatgagggtgcaaggaatttggctggggtgggaccagtttccacgtgcttagcaacacgtcagatctttcagtgttccaggcaacaacctaaacgtgtatcagtgtctgggaacatgcaagccccagccagggtttgagcctgcagggggaacatgtagctgattaggtcaga

SEQ ID NO: 338704 - DNA, 448 bp, Homo sapiens
catcacctgactgtgatactggttaagtctccacctgcaggggcctcctagcttatcttcactctgtcctgccctactccccttctctccccttactccccagctccactgcagtctcccaggagaagaacatcagctgtctccaccaagggtaaggggagggatgtcttctgagataacaaagcccacttgaaaattccactaaccaggtggtctcaaaactttgttgcacattaaaaccacccagggggtttaaaataatcccaatacccaggtgataccccacacaacagaattataacacaatgtctagggatgggagccaggaatcagaactgatttccaaatgactccaatatgcagtaaagtttaggaaccaatacactaatcatttaggcaggagagaatctactgggaataggaattcaaatcaaagaatcaaaactgg

SEQ ID NO: 338705 - DNA, 147 bp, Homo sapiens
ccactcagaaaacgagaagtatatggaaacttcttcaacatggcaaaagccatatatgaaatacctagagctaacatcatactcaatggtgaaagactgaaagatttttctctaagatcagggtcaaaacaaagatgtgcactttac

SEQ ID NO: 338706 - DNA, 189 bp, Homo sapiens
tcagtggggaaggtatacagaaagagcctttagcttcactgtgatagtaaaaggcagaaggtaatagagtgcattcaaaggttgttgtaatgagcaaatgtgtttttatcagagtctaaaagaaatcctggacaaggatcaacccaatttatgtgagtgtaacactgacaaggcgaatgaccaagttat

SEQ ID NO: 338707 - DNA, 353 bp, Homo sapiens
caacactaccaggatcttatttgttaggagggccagaaaaacagagctcgtcaatgtgcaagtacacagctctctggctgcttccattggtctcaaagttgccttgtccagaggggccattgactatggtgcattttaaggaggagaagagacatccaggatgccaactggggtccaggagacacagccacctgtcccacgagctccagagtgagcctgacatagggcaagtggaagccactcctcagacttcaaattcctcttgcaagacaaaggctaacatagggaagagttgtaaaagacactgtttccagaaatcctgctgaccacccacaacggtcttggcttacaga

SEQ ID NO: 338708 - DNA, 367 bp, Homo sapiens
caggcatggagtttaccagaaacatcctacatgcacagcttcagcaggacagcatgtaggtggagtcagcagatatgcacccagcgagactgaccagaggccgtgtggctcatgtgcacactctggtgtgaggctgactgtatctgagtatagtttttctgcttactgggggtgggatttcagttgcttgatcttttcagagtctcagtttcctcatctataaaatagaactggcactaatatctaaccgtagggcctggcacagtgattggcacatagcagtggctcagtatacaccagccgctgttggtgtgcctggaggtcgccccattcacagcagctgggtcagtggctcacacactcacac

SEQ ID NO: 338709 - DNA, 163 bp, Homo sapiens
tacacgctaaggacctatgactagctatgaaaaagacagcaagtgttccactctcctagctcatgatcgtaactgccacatattccattaccacctacaaacttattttaatgttaacagaatgatgtctcagtagtcacatttgtcatgctgacacaattct

SEQ ID NO: 338710 - DNA, 823 bp, Homo sapiens
  misc_feature (822)..(822): n is a, c, g, or t
ggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggctggagtctcagctcattgcaacctttgcctgccaggttcaagtgattctcctgcctcagcttcccaagtaactgggactacagaatgtaatcatcgcaaggccaggagatgcgtttggtctgtgctgcatctcaagcaggacaatggctggaacatagtagggtctccaaaaatgtttgttgaacgttgctgatggcggcatcctggagtaggaaaaagactgaagagtggaaaaagaaatcctgacatgaattctgggcaaaggcaagcagtagctgacttggaaaatgattacactatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataanc

SEQ ID NO: 338711 - DNA, 596 bp, Homo sapiens
  misc_feature (595)..(595): n is a, c, g, or t
caacaataattgggttaaggcttgcagctgggatattatacagcttgctttatctaggttttgttttgcttgcaaatcaatcaatacttacaatgattttaacaaggggaaagagccgtagttgtagaccttggagtgtatttttttttgtctagctttaaaaaaaattgttaatgttttgatactgtaactctttttagtagttgtggctttgcagaccttgctgcactttgatctttttctcgttccagctatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataanc

SEQ ID NO: 338712 - DNA, 202 bp, Homo sapiens
aattgtctcctctaaggaatggaacttagtgagaaaaatgtattttttatatttatgactcatatctttatctcaaacttgcctggattagccacagattggctgatctgaattcccaaataaaaagcattaaatgtttacctgatagcttaagaggtttaatcacgctccatgttaagtgtaacagtaattctgacattca

SEQ ID NO: 338713 - DNA, 688 bp, Homo sapiens
agccaagagctcttcttcagctgtattcttccatcagtaacatttaactttagggacttgacatctcatagcagtgaaactctttctcccaagcagctatttttttctgttctaaagtccgttccccccaaatagcgagatgttgactctaaagtgaaacaaggcacactatagaccttgaccttccccaggaatgactcaaaagcagtttggtgtttgggccccccttcaaacctttcttctctcagacaaccttactattaccagcaaggaagaggtcacccatttcctttctgctgtagcagcactgcccaaaatatggtccgtgaaatgctaggcccatgagctgctccagaatatgtggaaacaatacatgccaggcatttcccctgccatatatcatttgcatactggtacttaattggtcaattcagcaactctttgtggcttcctcttgcttcctgccttctagtgattcagctacagaactatttaaataacagcagataagtcaaccaattcatcctggggagactttccagttactgaccagtaaggtggtttcccccgaggtcagctgttcctgaaagctgtatgtacttccgtctttctcgctacagctgaaaccaatgtcatgagtcccctatccttgagatcagggcagttgattcagttcagcccaagagga

SEQ ID NO: 338714 - DNA, 270 bp, Homo sapiens
tccattctcctatatttatttgtggtttatctgttaagtatgtttatctattaagtatgttaaatgtttcctgcatgactaatggatattcaccaagttattccacagtggtgggatgtcagctttactttcttataattttctgtattccttgattgtcctacacatagtatgtattatctttggacttacaagaaaaattccataaaaccactttcatttcagaatgaaatccaaagttaagaccttttccctgggaaaggtgctgtg

SEQ ID NO: 338715 - DNA, 386 bp, Homo sapiens
tgggctctgttttctgtctcattgatctatatatctatctttataccagtaccactctatcttgattgctgctggctttatgataagttttgaaagcaggtaatgtaaaccctccaactttgttctttttcaaaatggtttgactattcttgaatctctatatttctatataagttttaaaatcagttttcaatttctaccaaagcaaaaattttttaaagacaaaaaaacccaagccttctgggattttgattgagagaatgtgctgcattttaaaacacattgggggccaggtgcggtgcttcatgcctgtaatcccagcactttgagaggctgaggtaggcggattacttgaggtcaggagtttgagaccagcctggccaaca

SEQ ID NO: 338716 - DNA, 368 bp, Homo sapiens
ccagtccttcctccctggccgtttgggaactgtccccacccctgaggccaatctggttctgaaccttctcttccttgccttgggcagctttgggggagggttagcaaaggcacagaacagaaaggccctgggctgtgcaggctccaaagaaaagggctgctctgggactggacctcctcccaggaccaaaaagttagggagggtgagagactactttagtttatcaaggaccctgaagagacaggaaccttcatctctcatccttcctccacaccccccaccaccacccctaaagaactcccagtctcggtcctttagtgagacttgctgacaagtttgacatctaagatgttttgtcccagaaagca

SEQ ID NO: 338717 - DNA, 777 bp, Homo sapiens
tatggtgatccaagggaaaatggaccgactcttaccctaagtccccagggttgtatgtcataacatctccatggaaatcctggaaatcaaagtgacaggacaactagtcacaaggtgtgatctctgcgatttgttggggactccaagtggaagtcagttaatgactgtctcaccgttgcagcccttccctttcactttggttctgtccctttgacccacttctttcctaaccttccctgactccatagatgaaaacttgaggagtgtgtgatgctgggagaggagtggatggagccttccccaggggatgtttgatgcttcctgagccagcagcctccctaatgcaaggcaccccattttggggagcgggttttctcaaaaatggaggaaaaaaaagggtggctgtctcgaatggcatcgacacagtggaaaatcatctgattccattgttgaacttcacactccaggcacttgctcatccctaagaaagaatagtacggcattcaagtttacatttacttctgttaatgaacgacacttatttggttccagaaaagcttagaggcagccagtgtttaggaagagatgtgttctttttaagattcgagtttgttgggtcctgtcccctcccccaagaaaactctcacattgttttgtaaaactttctctggaagaggtagagactaagaagttgacatcactttaagctaaccctcttttattcaagtcatagagcttgattgcctttctgaacatgcccctgaccaggacagggtg

SEQ ID NO: 338718 - DNA, 505 bp, Homo sapiens
tctatgaaaagttcagcgcaaatacaaccaagagtccttgaagaagagccagaagtcatctctctcccacttaattttatctagaaccttgctgtgcaaaccacggttcatgggccagcagcatcaatgtcatctgggagcttgttagaaatgcagactgtcagggccctatgtagcccagacccactaaattaaaatctgcatttcaacgaaatctccaggtctgtgttcaccttacagtgtgagaaacagtgacctagaaattactaaccgaatgcttcatgatgacagggatgctgtatatatgctgtttactgcagtatctccagtactgagaacagtacctggcccacagtggacacctgacataaatatctgtcaaataaatctacatgtgcacatttatggtactattttatactctgtaatataattatatgtataaaattattatatctgcacaatggtcttaagttccttacaggtgcaaatgttatcttatccc

SEQ ID NO: 338719 - DNA, 432 bp, Homo sapiens
agacggggtttcactatgttgggcaggcgggtctccaactcctgacctcaagtgatctgcccgcctcagcctcgcaaagttctgggattacaggcgtgagccactgctccgggcccatctccggcactttctatcttccaactgaaatgcggcatccattcatctcggggcccttcttgctgtgttgccctgcgggtggccagtgagagtctaaaatcccctgcaggggccctcgtctgcttttctttgcaggcctgtgtgtcgctgacgtggataaagcctccctgactgcagccaggccctgggctgggcatcttgtaggcttcccctccccattactgctcacagtgagggccatggacatacccacattacagatgaggacagtgaggctcagagagggtaactgcgtgcctaggttcacactgccat

SEQ ID NO: 338720 - DNA, 873 bp, Homo sapiens
tgtagttagaataaaacccagacttttttttttttttttgagatggagtcttgccctgtcgcccaggctggagtgcagtaagtgtcatttcggctcactgcaacctccgcctcccgggttcaagcggttctcctgcctcaaactcctgagtagctgggattaaaggcacctgccatcacgcccagctaatttttgtatttttagtagagatggggtttcaccatgatgtccaggctggtctcgaactcctgacctcgtgatctgcccacctcagcctcccaaagtgactgggattacaggtgtgatccactgcacccagcaaaacccagacttcttaccaacctctgaggcctgtgtgatctggtcctggctgcccctccatcattctgtctctcccttactccactcaagccgcatgggttccttgctgcttctggatcctggcataacttcttcctgcccaagggcctttgtagttgctcttttctctgcctgaaatgttctgcccctagtatttcctttctgaggcctacatttggttcagcttgctggtcacctcctctgagagactttccttgaccttcagtttaaagtagccatgctatttctaaatccctctccagtcttcttgtagtttgtcatagcaacagcctctacctggaattttctttttgtttgtgtacttgtttttgtctgtctcttctattagaatataagccccatgattatagggcgtttggtttgttcatcattgtatctccagtgtctgcagctgttctttgcaggtagtaaacattcagtgaatactttttgaataaattattaaacaaatgaacaaaacctaagacatgaaaaaactgaggcccagagaag

SEQ ID NO: 338721 - DNA, 627 bp, Homo sapiens
gtgtgacgttagcatgtcagtttgtactctttcaatctttttgatgtggcacttagggctatgaactttcctcttagcaccgcctttgctgtatcacagaggtttcgataggttgtgtcattattgtcattcagtttgaagaatttttaaatttccatcttgatttcgtttttgacccaatgctcattcaggagcaggttatttaatttccatgtatttgcatggttttgaaggttccttttggagttgatttctagttttattccactgtggtctgagagagtgcttgatatagtttcaattttcttaaatttatttaggcttgttttgtggcctatcatatgatctgtcttggagaaaatcccatgcgatgttgaataaaatgtgtattctgcggttgccagatgaaatgttctgtaaatatctgttaagttcatttgttccaaggtatagcttaaatccattctttctttgttgactttctgtcttgatgacttgtctagtgctatcagtggaatactgaagccccccactattactgtgttgctgtctatctcattcttaggtctattagtaattgtttcataaatttggaaactccagtattaggtgcatatatgtttagga

SEQ ID NO: 338722 - DNA, 432 bp, Homo sapiens
gggctgggccagagagaggaagcagaggtagcagaagggcctgcctgcagaatcctcccaacctcccccttcctttctcctcgttggcccagttaaatgtgtaaattactattccctccctataaaaatagcttaactccattacaaatatttgaataataggaggaaatctcaatcaaatgactgttagcatgttggtttcttcccatttattctgccttcttatgtgtatgtcttgggcagttcccatagagacatcacagcgtaatgacgattgtgccttctgctttttcacttaccatattcacctagtcagtgaatgtcagctgctgtactgggcactagggagcaatgaaaaataaaggatggttcctgccctcaggtagcttactgtccaggagaaattgaacagcagatccaattatgatatgg

SEQ ID NO: 338723 - DNA, 269 bp, Homo sapiens
ccctttccgcagtacctgcagcaaactcctcactgtttcccatcagcacactgtccactctcaagtgttggcaaggatgatgccttcccctgtggccccagccatggtagtgtctgatacacagcaggcaatgagtaagcaaataatttggcatctatcggacacactgaaaatactcattggatttttttttttttttttttcccgagagggagtcttgctctgtcgcccagagctggagtccagtggtgtgatctcagctcactaca

SEQ ID NO: 338724 - DNA, 367 bp, Homo sapiens
tatcagtgtggcctaatgtcttgctcccaagctgtccacgttaatccctggaaaaaaataccaccagataatctccttcaagtcatctctttcattacagcacaccgcttgttcctaaaagtaaaatgcagactttggtatctgttgttctttatagtctagccttggcttttttaagtgaccttaggagaaaaatatgaatggcatttgggccttgcctttgaggctcttagcatatagtcagagaaatgagacagacagcaccctgcatagtaataggtacagccatagaaatagtgccaggcatagagaacggatgattaattctcatgtgggcgcaaggacaggcatcactgagtagatgaca

SEQ ID NO: 338725 - DNA, 109 bp, Homo sapiens
attgactgtatgagctgcagggagtcctaaattagtagtaagttggttggttggtttaaaatacactagccttcttctttagaaaatttatatgccaactcataatact

SEQ ID NO: 338726 - DNA, 972 bp, Homo sapiens
agaattcggacaggggaccgctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338727 - DNA, 1157 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338728 - DNA, 929 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagggtttgtataggacattgacaattacatactgttacatgccttgtcaacgcactagttaatgtcttaattcagcaattatgatatagtcaggttttttgttttgttttttttgagacagcatctcgctctgttgcccaggctggagtgcagtggcgcgatttcagctcactgcaacttctgcctcccgcattcaagcgattctcatgcctcagtctcccacgtcgctgggatcacaggtgtgtgctgccactcctggctaatttttgtatttttagtagagacaggatttcaccatgttggccaggcttttctggaactcctggcctcaagtgatccacccacctcagcctcccaaagtcctgggattaaatgtgtgagccactgtgaccagccatgatagagttttatatttcattttttatatcaagcagatacatttttttgcatactttttataaa

SEQ ID NO: 338729 - DNA, 1087 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338730 - DNA, 1411 bp, Homo sapiens
  misc_feature (1165)..(1165): n is a, c, g, or t
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttaaaaaaaanaacaaaaaaaaaaaaaaaaaaaaaaaaaattttggtgggggccggccccaaaaaatttttaaaccacctgtttggggcggcgccccaagtagtgtaatgacactgccaacgcgtgtccagaggagacccggcagtaaatgggtggtccccaaaaaaccggcggaccgcggtttggaaaacacaggggctcgtggctcggcctacagcccgcaccccccgccgcgcgggaaacaagaggagaacagg

SEQ ID NO: 338731 - DNA, 1119 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtcgttatgggggcccacggttagtcccaaaggttgcccccttaaagtatcctataaaattcctaccatttttct

SEQ ID NO: 338732 - DNA, 1132 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338733 - DNA, 1283 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttagaaagaaaaaagcaacaggagaaagaaacttttgggggggcctgggcctgtaaaaagtttttagacccattcgtggggccgggccccatatggtatgagactgggaaaaggtgcccaggaactggggccgaacacagggcgggtttcccaa

SEQ ID NO: 338734 - DNA, 818 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacttggagaagttggcctccagtccccaagaagg

SEQ ID NO: 338735 - DNA, 931 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338736 - DNA, 1053 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgcccctggtaaccaccattctgctgtctttatgattttgactactctatttctcatagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338737 - DNA, 1147 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattggctctatacgaacaaagtagaggcttagaaaatgggagattgtctggaccatctgccacgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338738 - DNA, 1112 bp, Homo sapiens
gatactagccatagcattcatgagtttgtcgcgcgccggtatggtgatagtgcatgtgggcatagtctgtctggtacggagcatcttggacatcgactaagtgatttggagtggctcacctacatatacagatagagcgttcccggagagggcatcggtagctctctgtgacagacaatacgtgaatgaccgattcgttgaagagtcgacttacttggtctctccatcgacactgcgtagtactacctatgaactcggctgttctaattgaacgtccactctgaacgatgtctacattgccattgtacttggtgatttccagtagccaattttcataactcctggtgaatggtattcatttggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338739 - DNA, 980 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338740 - DNA, 1097 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagctcagactcacacactaaaaacaacaaacccccacccacacaccaaacaacacaaaaccacacccagaagagataagtggggggccgtcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338741 - DNA, 918 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338742 - DNA, 956 bp, Homo sapiens
ttgagacagttttgctctgtctcccaggctgaggcaggaggatcacttgagcctgggaggtagaagttgcagtgagctgagactgcgccatagcactctgacctgggcaaccgtgcaagactccgtctcaaaaaaacaaaaacaacaaaaaaactgtttgatagctatctatataagcaacataataaaagtcaaaaataagtcccaaattttggttatagatatataccagatgtatgcctacataagggtctgtggaggagcattatactttacataaaagcagactccagtgattgtcctttatggaaatggctcattaaatttataattggaagtgctggaatctcaatattgctgttccatttgttacagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338743 - DNA, 895 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattgcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtggttcagtccccaagaagttacatgtgctattaaactgcggaaatgattggggaggcctaaatgtacacttgaagttatgtttttaccgacaagggtaaattaaaaggtggccgcatgattggaagcgtggaacgctttagggaccggaagacaatggaccatggttaaacgcgaag

SEQ ID NO: 338744 - DNA, 900 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggggggcgtacgacagggtaactcag

SEQ ID NO: 338745 - DNA, 1106 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgggtaattcaatattcccagctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338746 - DNA, 998 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338747 - DNA, 986 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgcccctggtaaccaccattctgctgtctttatgattttgactactctatttctcatgtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338748 - DNA, 1044 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctgggtaattcaatattcccagctcctgttcgacacagtggagaccatgggaaaagactatttgtcatcagaccttctagattctatgacaggcgttttttgaagttattgagattctacattgcattgactgggattccagtagcaattttcataactctggtgaatgtattcattgcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 338749 - DNA, 959 bp, Homo sapiens
aagagtggtatcaacgcagagtgcccattacggccgggggtagtgcccgtagtagccatggcggccatgagtttgttgcggcgggtttcggttactgcggtggcagctctgtctggccggccccttggcactcgcctcggatttgggggcttcctcactcgtggctttccgaaggctgctggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtcctaagttggacacatctaagtatcttttaaaggttggcaaaaaaaaaaaattggcgcgaataactgcggggaagaggttggcgttgtcaagggg

SEQ ID NO: 338750 - DNA, 1703 bp, Homo sapiens
  misc_feature (1165)..(1165): n is a, c, g, or t
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttaaaaaaaanaacaaaaaaaaaaaaaaaaaaaaaaaacaaaaacaaacacaaacaaaaaaaaaaaaaagagggggggcgcgagaggacaaaaagatatatcccactaaagaggcgagcgccgagacaaaaacgaagacacacacaaaattcgtaagaacaaaaagagagagccacaaaagagggcgaccaaataaaagacaaagacgaaggacgagaatacaaacaaaagagaaacacgagagaaaaaaatgatacaaaaaaaaggagaaatacggagaagaagaaacaccaaaacaacaccgcggcgggagacagcaaaaagatagagaggcaaagaaacgctacaccaaaaagaaagataatcaacagacgaccagatgccagaaacaaatacacacacaaatctaaaagacatgaagaagaaagaggacagacacaaaacaagcgcacaataatagtacacgcagaaggaaaaaaacggcccaccaacacgaacaccacacagaagccaaaaaaatcaacacacgcgggcacccacacccgccca

SEQ ID NO: 338751 - DNA, 1222 bp, Homo sapiens
ggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttaaaaaaaaaaaacaaaaaatgaaaacaataaaagcaacatagtacacagaaaagaaacaaaagagg

SEQ ID NO: 338752 - DNA, 365 bp, Homo sapiens
gtgaggagacaaattgaagtgcttctctatattaaactgtttccccaaagggttacaccctcagggaaagggcaaattagaagtcctactccattccattcccaacaccaggggacttaaggaaatttgtctattgctgagcagattaaggaggaatgtccctgagaagttgtaactaaaaggtggtccttgagccaatgtgcagactgaatttacatcacttaaagaagggtacattcaaacacttcagatattgaatcattagacatatatggtaaaacaattatgcatactatatttaaagatagaaataaaaagtgggataaaatttaagaggaaaaaaattaacaaaatgtgccttagca

SEQ ID NO: 338753 - DNA, 1049 bp, Homo sapiens
ttaaacactgtgaggctttagaggagttggagaactgaaaactcttcttgttgaatatttcataaatataatttatttaacttgaaccttcatctgaaaagcttccctttcccccttaagaaatttttaccaagaagagtaagctaaagctattgcatatttttggcagagaaaagtagattaacttttggtatatttagtgaccaccatgagcacatctgaacgcagcagcagctaacatgtgagagggcatgatctgcccaattattacaagattgcatttcctcatgccatctctaatcagaggaaaaggtttaaattagcagcaatctcaagaatgtgaatcaagtctgggcagaacttttgtatctgactcagtgtaagactgtttagttcttgtttcaagtagtctgcacaacaaataccatgcctgcaaatatgcaacaaacactcccaggaagaatatgtttgtttcttccatggattcaggtaataggaactatgaacagatcttataaaattttgtgggcatttatgtgttgctattaaaatggaataaagattttctatttctgggggcaatgtagatacaaaattagaaagtcagacaggtagatatgtttggcctttaaataaagtttagctttaaactcctaatcttattgaggtacttaaaaatatgtaagaatcaaaatattttactgacagtggaaccatggttaagtcaagagctttagggaaaagagtatatgtatatgaatatgcctaaaagtaaatagggataatggattcaagtttttgtttcatatgatatctaagaatcagatttcttggagtagaatcccatgagtgaattcatctttccacaaactatgtcatcaggctcatttttcaaaaccaatgtgcacaacacctggtcaaacttctgcgtcaactacattccgtgtcaataaaatgtttgctttgccaagggagactctgagaaagtgaccaatatgtagcaactgagaagtcatttaaaggacatcagaaaatgactgagcctcgac

SEQ ID NO: 338754 - DNA, 350 bp, Homo sapiens
gcgacactcacgctcacacagactgcgacctaccacgccacaagagcattaagatagcctttcttcaagctcactaattctttcttctacttgatcaagtctgctattaagatacttgaaggagatgtggactgaggtacccaagagtggcaatggcaagaagaagtccacgccaatcaagaaagaccactacatctccaagacgttcctgcgtgaggacagagacatcgtggttctgaggaactcgctcatcgccagcaagaaggggccatccctccgtcgacggaactcattcccctgtcctatggaggccactgccattggtgttgagaataataaagcactgcatt

SEQ ID NO: 338755 - DNA, 622 bp, Homo sapiens
  misc_feature (603)..(603): n is a, c, g, or t
ttcgaactagaaaacacaaagtgtaaattacacacaggcaaataaaacgttttctgcctcttaggcagaaattgagtttcataaatatccattgtgtcatagatacaaatttaagacattgtgaggtctacttgttaaccttaccgtgttatgatctctactttcaagagcttcaaaggagatactttattgctactagcagaataatttaatggaactcagattcctcaaagataatgatggaatagggtaaggggctattctgtttggaaaaaactacaagagatacaaaaacttgtctatacttcgtggtagtatacagtgttactcagagtaccagtctgtgatgagataagatgcttgagggccagaatataaatcgacacacagattccttcatagagaaaaatgttgctaccggccccccgctcaaatctgagctaaaacaatgtgcctagtgacatcgttgacgtatattctgactcagcctcttcacctcacactgataaaataggtaaccacactatgagtagcactaatacaaataatactcttagcatcaagaggatattgattaatattgtctgtgaactcgacccagtntaagatcctgtaatcaccc

SEQ ID NO: 338756 - DNA, 283 bp, Homo sapiens
gggcagactggcttcccaaatctgagctgggggttggggagacacagaaggtagggtctggataaatgggagtttctcttgattctaagaaactggaagggacctggcaaccagcctctgggagagtctgggggagtcctaggcaagtcttgacagaaacgattgtcaggcaggatatgtctgagaccaacccccggggaaactgagagagatgaaagaaggctgagtacctcagatgaggaattataaggagtagcctgagctgtaacatcccccatgttgg

SEQ ID NO: 338757 - DNA, 322 bp, Homo sapiens
cctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaa

SEQ ID NO: 338758 - DNA, 199 bp, Homo sapiens
ctttatttaccctacgcagctggaagaagagtagataccctccacaggaccaagtatacaagctcagttctgccacaacaattctatccatctctgcttctccttcctcaaaggtccagcactgtgtaatcctaaagcaggcacacccattcttatttcctctcaatccacgatgttctgtcagagaatcgctcagttg

SEQ ID NO: 338759 - DNA, 611 bp, Homo sapiens
acgtgataataaatcagccaaaaaaataattaaaaatatcgagcccgcttagatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338760 - DNA, 616 bp, Homo sapiens
  misc_feature (38)..(38): n is a, c, g, or t
atatttacgctcagttcacacataatatacaccccgcngcgggcctggtaggaactcatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338761 - DNA, 572 bp, Homo sapiens
ttctttcatcccacttttcaatccgactataccccccgaggacggggctgttatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttccaaaaaataaaccaaaatgggtctctttggcctcaacggtggaacttatgtgc

SEQ ID NO: 338762 - DNA, 554 bp, Homo sapiens
acgtgataataaatcagccaaaaaaataattaaaaatatcgagcccgcttagatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttataaagaaaaaaaaaatggccctcgttggcctcatt

SEQ ID NO: 338763 - DNA, 640 bp, Homo sapiens
  misc_feature (52)..(52): n is a, c, g, or t
  misc_feature (75)..(75): n is a, c, g, or t
gttacccatttcctccaccgaaatgtacagtaaggccacgacgccccacccntttacgtagcagacctcacaagnaaaaatatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338764 - DNA, 623 bp, Homo sapiens
  misc_feature (53)..(53): n is a, c, g, or t
tatatatataacaacaaaaattaattataataaaaggggggaggaccctttangagtgacttacatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338765 - DNA, 611 bp, Homo sapiens
ttctttcatcccacttttcaatccgactataccccccgaggacggggctgttatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338766 - DNA, 613 bp, Homo sapiens
gatattaatttatctcgccgtgcacacaggcggccgcggctcactatgacttacatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338767 - DNA, 614 bp, Homo sapiens
taaatacataccccaccacaacatcacccctttgggggccttactatgactacagatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338768 - DNA, 614 bp, Homo sapiens
  misc_feature (55)..(55): n is a, c, g, or t
aatataaaacagggttgtattgattcttagggcggccctcagtattgcctacagnatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338769 - DNA, 613 bp, Homo sapiens
  misc_feature (53)..(53): n is a, c, g, or t
ccacgctccttactacttctctacgccgccgaggggtcccttgttatgactancatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338770 - DNA, 340 bp, Homo sapiens
acgtgataataaatcagccaaaaaaataattaaaaatatcgagcccgcttagatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgattttttttttaaagggcgtggttctaagaaaagaagaaaaagaaaatggcctcggggggcctga

SEQ ID NO: 338771 - DNA, 572 bp, Homo sapiens
gtttagatgctcgttacaagagttactgacggtagtatgagaacatacctagaatagaaaaaaaagggatggaaaggtgggttgaattactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaac

SEQ ID NO: 338772 - DNA, 276 bp, Homo sapiens
tgtctttgcagatttgcaatttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagtt

SEQ ID NO: 338773 - DNA, 157 bp, Homo sapiens
gaatctctcatgtcacatggccaactccagaaattttcactcctctgctttattatttttgagaaacattagtctcatgctacagcattatatggcactattgatgggagttcttacacaactagtacattttttttttaaagtttgtggcttgagt

SEQ ID NO: 338774 - DNA, 207 bp, Homo sapiens
tcattgaatattcactgcaacttgattaggtttaggttttattatcacatttcacaaagagagaggggcctaggaaggaatttgatatgaatgtgaagcatgggagatttcagcagggagagaactgcagtgaagtgtggaaggaggggaagtgacaggaggtgttttctcaccaagggaatagtgtgaacaaatatggggattaca

SEQ ID NO: 338775 - DNA, 256 bp, Homo sapiens
actgtaccccgacttcacactattagcatcaggcaagttaaagctaattcctgtacaggagtccttaaacgtgtcataggaacactcacatttattttccacaacaaggaatgattacaagtgaggggagaaaaaaaggctttttattatatacaacgtcttgcctttataaaaaccaacagaccctctttttttattttttaactaagatttcaacatcctttgatctagttaaagctcagaattcatacctcct

SEQ ID NO: 338776 - DNA, 407 bp, Homo sapiens
ctgcctggtgtgggtgatgcagaacagctcttggctaataaatgtgccgcgtttcccagacaggagacgacgtggcctagtgcataaataagacaagcctttttaaaaaagaaatctgtatttaaggatgtgtttggctgtgttcttctcctcccgtaaaggtcacccagatagatttttccttctttagcattgcaggctgcgaagaactgggcatttctattctccctccatccagtgaacctggcggactaaattagattctgaaattgagtgtgcagtagagtcggtgagttaccgtaatgggagggtactgcttctcaccttgcaaggagcgaggtcatgataatatgaagcgaagtggattaaaaataaaaccaaaggtatttatttatgacctgctcaga

SEQ ID NO: 338777 - DNA, 567 bp, Homo sapiens
tattttctacttcctagatgagtttatttcctggaaggatgacatcaggttgtagttttagtcagattcctcctcacccatccccttcttctccaaacctaaacggttgaatggaaactgtcttatcagaccaacccactccctcgtggccccctaaaaggacgagctcggacctcactcccagaaaaggtacaaaatgatcacatttgctgacacgtcttccgcaaaactgccttagtgcctctgtccactctcctcgcaggagatgaatggtccacttggtcctcatttatcactcaaggcttggctaagatctgtctcgtttagttcttcccttccccactagaaagtctgcactccgacattaattcttctgtgatgacagctaattcagacttaacaggccacacttactcaagaggcaggaagattctctgtcccccaaataaataaataaaaacaggacttcatggcttatgatagtgaggctaattatcaacactgatcggtgctacttggtggctctgtttaaaacccaaattgattttttcccccttttctctggga

SEQ ID NO: 338778 - DNA, 434 bp, Homo sapiens
catgtttttctattttattcttcttcctaacacttattaataactgcattagacagaaaacaaacaggtaaacaaatgagctacatgatgacaaagtgatcaaagttatgaagaaaataaagcaaggcttaaaggagggggctactttggatgggaggtcaaaaagggcctctttgagaaggtgacttctaagatgaattttaggtgatgaaaatggcaccaatcatgcaatgattttagggaattccaagcagccagaacagctttgcagagtcccaaagtgggacggaaattcacttattagaggaacagaaagaaggtttgatttgctagaatccagtgagcaagggggtcctggagcacgagtcagatcatttgaacattatggtccattgaaaagagtgtatattttagtgtaagtgcatattggaact

SEQ ID NO: 338779 - DNA, 288 bp, Homo sapiens
agagctgtgcttcctgtagctgcttgcatcagccgccctgaagtggcctgggttcctggggctcaaaatctttaattagccaaactcaacacctgccgaggtgtgcctgatgaattctcaccaggtgatgttcgcgtgggcgggcgttacctgctgcgccatccctgtggctcctggcccctcctggcccttatctcccaggaaaacaaacaggtcccagggcaatggcctgggccattgatttactgcccgggttcacactacatccatgacagatgccattctgat

SEQ ID NO: 338780 - DNA, 464 bp, Homo sapiens
ttcttttttttttcgtttgggacagagtcttgctctgtcgcccagtctggagtgcagtggcacaatcttggctcactgcaacctccacctcctcctgggttcaagcgattctcctgcctcagcctcctgagtaactgggattacaggcgcccgccaccacacccagctaatttttgtatttttagtagagacagggtttcactatgttggccaagctggtcttgaactcctgacctcaagtgtttcacctgcctcggcttcccaaagtgctgggattacaagcgtgagtcaccatgcctggcacatatttaggtttttaatccacctggaattcattttatgtgtagtatgaacttgtatctaattattattttttaattcaatgaataaccagttgctccaatatcatgtttagaatagtccattctttccctattgacctgcaataccacttgtatgtacta

SEQ ID NO: 338781 - DNA, 415 bp, Homo sapiens
ctggggtgtagtggtgcagttacaactcattgcagccttgacttccaggctcaggtgatcctctcacctcagccttctgagcagatgggactaccagcacataccatcatgctaggctaattttttgtatttttagtggagatgaggtttcactatgttggccaagctggtcttgaactcctgacctcaagtgtttcacctgcctcggcttcccaaagtgctgggattacaagcgtgagtcaccatgcctggcacatatttaggtttttaatccacctggaattcattttatgtgtagtatgaacttgtatctaattattattttttaattcaatgaataaccagttgctccaatatcatgtttagaatagtccattctttccctattgacctgcaataccacttgtatgtacta

SEQ ID NO: 338782 - DNA, 542 bp, Homo sapiens
gggtggggtctggtaatggaaacaagttcatggaccacctttgagaagtgctagattaaaacctcatcattaccaagagggagattttgtatggatagaagagagaactttctaatagtcatatctatattctgatccaactattgctgcgtgccagcatttggattggtgctttcatatacacaatttcatctcctcttggtggctctttgagtaggtgcctgcagtttgcagatgaggataccaggctctgataccttcaagagagtattaatctctccctcctttcttctaacttggggccctgcacctgcttcatttggcattccattatgtgcttatggtgagtctccctatggaaattgtgcaccttgatgttgttgaaggcctttgagtgttgtctggcgaaggtcacagattgtatctgttgagctgaaatgccccatctgctgtgaacaggcttgagcgatgaggaactgagggacctatggagcagctgccccatgtgtcactaaggtgacatcaatcctggtatctggagc

SEQ ID NO: 338783 - DNA, 382 bp, Homo sapiens
tgtgtgtgtgtgtgtactataaattaaatacgattatatatgatcagcaaaataacagtgctctcacttctgggtagaaagaaggattacggataatttttcctctttttatttgtgtgtgttttccagattttccacagtgaacaaatactcttttatactaaaaactgtttgtttgcttgtttgcttgtagagacaggtttctcatgttgccagggatggtctcaaactcctgggctcaagcgatccgcccgtctccgcttctcaaagtgctgggattaaaggtgtgagccactgcaacgggccaagactttatattctacataaagtctctcatatttgtggctcatgtttggaatttttacttttttttttttttttt

SEQ ID NO: 338784 - DNA, 378 bp, Homo sapiens
attcaacaaacatttattcagtgcctattatgtggtatggatagatagatgaagttgacacagtgcctgtcatcaaaaaattcacagattagtggggaggccagaccatgtgttagggttgaacatttgtgaacagagatggatggtagctaggcaagggtggaggtgatgtctgagctgagtttaaaggatgattaggacgtggttagcttttcatgggtattctggtgcagaggaaagggtgggaaagtctgagaaattagaacacgtggagaatatgaggaagcagctggtagtttggagttcttggtgcttaaaggttgagacagggaggtacaaaagaagtgaccagaatgatagatggtgggggcctttagt

SEQ ID NO: 338785 - DNA, 638 bp, Homo sapiens
tggctcacgcctgtaatctcagcaccttgggaggtggaggtgggtggatcacttgaggtcaggggttcgagaccaacctggccaacatggtaaaacccggtctctactaaaaatactaaaaaaaaattagcccaacgtggtggcaggcacctgtaatcccagctacttgggaggctgaggcaggagaattgcttgaacccaggaggtggaggttgcagtgagccaaggttgcaccactgcactccagcctgagtgacagagcgagactccatctcaaataaacaaatacaataaatagaggacttagttaaatgacttctaaagtcccttttaactcttaagtctgtggttttataaatctgtagctatagtttatgtgatgctggggctttgaactggaatgtaacccccaattatagctacattttctaggactacatctaagtgaaatcaggagcagtctatattgtgtttttctaaaatacttaagttcttctttttttcatgttaagtttgagattttggtagaataggtggaactatcctacaggtaatttgaagtttgggtctaaaactgaggagagaaatcaggactagggatagatttggggtatccatgcaggtgactgttaaatgtg

SEQ ID NO: 338786 - DNA, 326 bp, Homo sapiens
cagctcccgtggcagcggcacagctccccacagcgtggacctacacagtcgagcaccatttacaacagggggccgaagctcggccgtgttgtggcagtgcttggtttggctgtgggccctgccactctcacagtgcacacagaaccggaaccaggtctcacctctgtgagcctcaaaactccctcagcctacatggggcccaacccgtggctactgcatacctcgaatgagtgaataagcaccaggagtgtggcccagtgactggtgcagttagctcccaacaatgcaggtgccgtggatgggctttttttctttttttttttttt

SEQ ID NO: 338787 - DNA, 724 bp, Homo sapiens
tctgctcacgctcagagctgctgcctgcatgcttgtctggaagccgacatcaagcccatttggccagaaatacctctagaggtggaactggcccagaagactggacccccagagtgctatggaatgtctatgggaacaaaggaggacctaatggacagcagagaaacacgatgcccagctctggtctggtaggaggtccctagaagaatggcttcaagtgagacttagaaatacacccagtcggttagcctttgggaagcgtaatgagtactacctccagtagtttttgaagaacagctacaatgcttcacgtggaccaatgcatatcccatggcgaggaagacacatatgtgattcattttcttcaggatgaagtttaaggatttacctaaggacccaagaatgttgtgagatgaggaaacagaagctgggatatgtgagtaaacatttccaaggtcctgcagctaatcaatggttgacaacttctttcctctgcctatgttgccatccatgtcatggtttgtgtcaagactctaggagaagtctaccatcagcaccacagctactgtgcacaaatccagaatgccagactgaagtcagaaggaaagagatgatgcagctcattgtgatgctgagataccacgccagtgcctgattacccccgatctgagcctagggctggactgggaaccctcgttcaaactccggctgtcctgtgtatcgg

SEQ ID NO: 338788 - DNA, 733 bp, Homo sapiens
caaatttaaattctatgattcttcaaattgaacaatgatctggacttgaaataattttaaaggcaacaaatgtccctgctgtactggactatgttttactgtctgtagaccctgaagctcaatatgaactacagaatacccaaacttgtattaatgtaaatcaagtgttgaggtttttaaaagaacactggagggaaaaactgaccagtaaaaataaaacatttcggtgtgagttcttcctttaggaagaggattggcaaatacttgaatttggcctttgtcccagagctcttatctagcagttggtaatcggaggtcttttactgtaatgcttcaattgctgataccgtatgtgcctactagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgaggtgagtctaagtcaaataatagggtgacctaaaccccaaacacaactcgggcatgctcttgtgttcactgacggggacctgagatgctagatggcatatatccacatttaatgtgtgagttcaaccatacacatacttgac

SEQ ID NO: 338789 - DNA, 2092 bp, Homo sapiens
cccgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaactttaaagtcagtcctgtgtatacctagatattagtcagttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttt

SEQ ID NO: 338790 - DNA, 2033 bp, Homo sapiens
ggggttcgggcgtgcgctcctctgctgcgacccacggagtgcgacgggacagccacgttttcacatcgggccccgtgaaatttttccaatggaaaggacttggtccagaaaaacgttagtttcatatggttcgcccggtacttaaatgttttattttctcccccaaccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaactttaaagtcagtcctgtgtatacctagatattagtcagttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttt

SEQ ID NO: 338791 - DNA, 1963 bp, Homo sapiens
cccgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttctaatgggagccaattcacaattcactaagtgactaaagtaagttaaacttgtgtagactaagcatgtaatttttaagttttattttaatgaattaaaatatttgttaacaacaaaaaaaaaaaaaaaacaaaaaaaaaaaaaaaaaaaaagaagcaagaaagagcaacacaaaagcaatccacaaaggaaggaggcaccgcaggtgcggagccagagtaccccagctagtgcggaggcaacaccagggggccccatagcgcgagcattcatctgctacagagggatctgaggccacgtagcgggcgccagcttctccaccacgcatagacggccagcggaacacgaacgggcaacaccacgaggagatcacgacagaaagagagaccccctcagccaagcgtgcacccctgcgcgacagagagcggggcacaaacctccaggcagccgcgaaaccaccaacgcgcctacgaggcgcccactagcccaacacgttcaaacgcgcccacggcgagaaaaagcagtgcggacaacgagcaggatggcggacacgctgagcgcaacgggcatgcacacgagacatgaggaccaacggcacgaggaagcacgaaaccagaagacagcctagaggtg

SEQ ID NO: 338792 - DNA, 2169 bp, Homo sapiens
agggggacactagcagtacgagctggtggatcggccgagtgcctcccttccgcgtctgtctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttttttgggacccggccccggaagggggacaggggttggggaaacccccttcctttcccaaaagggaacatttcaagcacttgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaactttaaagtcagtcctgtgtatacctagatattagtcagttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttt

SEQ ID NO: 338793 - DNA, 1832 bp, Homo sapiens
caaatttaaattctatgattcttcaaattgaacaatgatctggacttgaaataattttaaaggcaacaaatgtccctgctgtactggactatgttttactgtctgtagaccctgaagctcaatatgaactacagaatacccaaacttgtattaatgtaaatcaagtgttgaggtttttaaaagaacactggagggaaaaactgaccagtaaaaataaaacatttcggtgtgagttcttcctttaggaagaggattggcaaatacttgaatttggcctttgtcccagagctcttatctagcagttggtaatcggaggtcttttactgtaatgcttcaattgctgataccgtatgtgcctactagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaactttaaagtcagtcctgtgtatacctagatattagtcagttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttt

SEQ ID NO: 338794 - DNA, 1636 bp, Homo sapiens
cccgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcac

SEQ ID NO: 338795 - DNA, 2311 bp, Homo sapiens
cccgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaacaaaaaaaaaaaaaaaacaaaaaaaaaaaaaaaccggggccccgctgccccctttttttccccaccccccatttttttttaccctggccgggggccccccctttagaaaggggggccgagggattaaagggctttcggcttcagaaataaaaagggcccttacccatttttgccacaaggggccactctatacgcgcttttatcccatttgtttttttttttttcgcaacccctccggctttctttttaaaccaattagaccggggcgcgataagcataacgggataaatatgtggggggccccctcctcttcgccttatggggaggcgcccccctttatagtacaacccatagaacttcccctacagttattcattctcccctcatgctgtgggcctaccaagagagccgggggcttgcaaccaccagtttacctattgttgggctccgctcgaacgttgtcccccactgtctttttgttaccgccgccccagcgccgcccatgag

SEQ ID NO: 338796 - DNA, 1801 bp, Homo sapiens
ttgtcaattcagtcacgcagggtctagcgatgtgcagagtacttccctttggcatcggcgaacgaatggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaactttaaagtcagtcctgtgtatacctagatattagtcagttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttt

SEQ ID NO: 338797 - DNA, 1621 bp, Homo sapiens
gaaaacatacattcttttatgtaagtgtcaataagaagactatacatttcagaatgtatgttttccatggcaatttggaagccatagaaacagcgggattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaacaactttaaagtcagtcctgtgtatacctagatattagtcagttggtgccagatagaagacaggttgtgtttttatcctgcggcttgggtagtgtcctgggattctctgccccctctgagtagagtgttgtgggataaaggaatctctcagggcaaggagcttcttaagttaaatcactagaaatttaggcgtgatctgggccttcatatgtgtgagaagccgttccattttatttctcactatattttccccaatttctagttgataagaaaaaactattgaagagtttt

SEQ ID NO: 338798 - DNA, 1434 bp, Homo sapiens
cccgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggatttgtttttctaaataaagttggaaaagcaaaaaaaaaaaaaaaaaaacaaaaaaaaaaaaaaaccggggccccgctgccccctttttttccccaccccccatttttttttaccctggccgggggccccccctttagaaaggggggccgagggattaaagggctttcggcttcagaaataaaaagggcccttacccatttttgccacaaggggccactctatacgcgcttttatcccatttgtttttttttttttcgcaacccctccggctttctttttaaaccaattagaccggggcgcgataagcataacgggataaatatgtggggggccccctcctcttcgccttatggggaggcgcccccctttatagtacaacccatagaacttcccctacagttattcattctcccctcatgctgtgggcctaccaagagagccgggggcttgcaaccaccagtttacctattgttgggctccgctcgaacgttgtcccccactgtctttttgttaccgccgccccagcgccgcccatgag

SEQ ID NO: 338799 - DNA, 1314 bp, Homo sapiens
tttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagc

SEQ ID NO: 338800 - DNA, 605 bp, Homo sapiens
tctcgctctgtcgcccaggatggagtgcagtggcgcgatctcggttcactgccagctccgcctcctgggttcacgccattctcctgcctcagcctcccgagtagctgggactacaggtgcccaccaccacgcctggctaattttttttgtatttttagtagagacagggtttcaccatgttagccaagatggtctcgatctcctgacttcgtgatccgcccgcctcgtgctcccgaagtgctgggattacaggcgtgagccaccgtgcctggcaaaaacagcctcatgttttaaaaaattatctggtctttatcatatgtcattccttcagaccctccattatgatgtcagtgaaggttatgggcatcacagcattagtagctgaagttattaattaggttcacaaaacttcaagtcaatagtttttatatcacatgtagaatgtacatgatatattagtattggtatcttttaatgaaggtgtatgttctacagtatacaaatacattacaggtatattttatattatttattatatggctccatattatataccatattgggtatgtaaatatgaatgctttatacagtgataaataaacaaa

SEQ ID NO: 338801 - DNA, 186 bp, Homo sapiens
ctgctggcctggactgctcctccgatcaccagacctgaggatctacctgcctgcttgaagaaagcatctcaaacttcaacgtgcccaaaaccgagctcctgagtgtctgctcaacctgcttcctgagaaccctgcctgtctccattagggtcaccccatccttccaggtacagacaaaagatcagg

SEQ ID NO: 338802 - DNA, 85 bp, Homo sapiens
tgaaccaatctctgtagccagggggccagaggatatgggattctctgattggccaggcctgtgtcaagttgccaattcctgaagg

SEQ ID NO: 338803 - DNA, 667 bp, Homo sapiens
ggagctgtcagcaggctccagagaccatggccataaagcactgacactgacacggccccagcaagcccttggggaagggcagccaccaccgttgctgctgctgtcacttactgttgctgttgatttaaggcagtacatactcaggtctcatagcttgtaaaacaaaggaaaaatgaaaagtcaccatcatcccagcaaaatgtaaggctcccctgctgcccagattggaatgtgctcgggagggccctggcagtctgggctccagcaggcctgggtgggcctgggtgcctgtgcgtctcacccactcccagggcgtgtggatgcaactcctcagggtcacactttgaataacaaggagctaatgagtagccttcccaaaaatgggggccaaatccctcaccttcctgagccctcccacggggagagggagggtcttttatggagcgtggtgcttcatgcttcatcgttcagaagggagcgtggtatccagaaacagggaaagcattgctgagtaacgtggcggagtgagcaggctccagacaacgcatccaccaagagttcttccatgcgctggtgattccccatccagcagtaaatgttgttcatgtttacagatgatagctatggaatacaggcctttcgtgagtggcaaatttcttattcttta

SEQ ID NO: 338804 - DNA, 89 bp, Homo sapiens
accggaaggcaacacaaaatcaagtcagttctgtcaaatcatggggaaggtacctcctgtgaaatgtttggaagttaaataatgggaag

SEQ ID NO: 338805 - DNA, 403 bp, Homo sapiens
atcctcaggttcactctcaaacccatacagagatactcacacttaggcacacacacacacacacacacacatgcatgctcactcacccacacatgcacagctcataagcccagggcacaggcccaactggggatgcctcaacagcagccctatgccctctctggagccctagcatcccccatggctgcctggagcccagacaggttttaggaagggtggagacccagcccgtctccacgcccttagccaagggaagcaggtacagtttccagcagcacccctgtcctccttccagctcctcagactttcttcccacactgtgggaacactccttggcactttgagggtctcccttcacctcctagcccagggaggaccaccagccccgacaatgcactgcagt

SEQ ID NO: 338806 - DNA, 398 bp, Homo sapiens
atcctcgagcaatgtacttccttcactagaacaaaaacaaaaatctttccaactgaattctaagcttaggagtcacatacaaataaatcaatgaaaataaattttaagacatcacgaagttaccgtaagtttaaaatagcataacacaatgaaagcacaaggatgcttctcaaagcatcccttctacatttatttccagaattctaaatttgaattcagcaacttatctaatctagcaaagagttaataagcacctccagaaagcctgagtgatacagaagaatcaaaaagcatgagttcaggctgggtgtggtggctcatgcctataatcccagcacttccggaggctgaggtgggaggatcacctgaggtcagcagtttgagaccagcctggtcaa

SEQ ID NO: 338807 - DNA, 256 bp, Homo sapiens
ggagactatagcaaatcatgcctgggtagccacatgtcactgaggcctgtgtgtcactgtggggccctggccaggttgctgacagtctgttaacctcagtctcctcattggaagcctggctgtgtgagccctgctaggtaaacgtaaaggacataggagaggctcaagttcagccttggcataggggccaagctgggcctggatccgggttccatcctgccccatcatgactctgtgcagtcgacacctgtcacca

SEQ ID NO: 338808 - DNA, 310 bp, Homo sapiens
ctgggcatggtggttcatgcctgtagtcccagctacttgggctgaggtgggaggatcacctgagcccagggaggttgaggccgtagtgagttgtgattgcctgacttcactccagcctaagcaacagtgagactgaaaaaaaaatagagagagagagagtgacagagctgagtgccaaagtctttagtgagtaaggactatgtttgtcagatggcacaatgaagacggttggatagctccatagtcaaatggcctggacttcaacagaataggaagagtgcattatataagagggtaggttagtaatggt

SEQ ID NO: 338809 - DNA, 344 bp, Homo sapiens
gatgtgagtcagcttcatctagcagagctctaacttcaactaagacaaaagtgtatttttcacagaaaccaaagctggagcttgacagtctagtgtgtatacaaaatttgagggaccctgttttttttccagtgaactgttctgcacttcctaggatgtgaatctcaccttcacagaacaaattgatgggaagagcaccaaccatcacatccataggccaaggaggagagaggaaacaaaaaaataagaaatgaggcagaagatagatgtaaggtttcaaaaaatgccacacaacactttcattactttgcattggtcagaatctggtcacatggtcacagctt

SEQ ID NO: 338810 - DNA, 304 bp, Homo sapiens
ctgagctctgtcttatggaagagaaattgacacatcaaggggttcagtaacttgcccaagatgaaacagccagtaaggagtagaaatgggatttaagccctggcatctgactccagagcctgtattcccttctttccttccttctttctttttcttttgttttaaatttggaaattatttcaaatttacaaaaaagtgcaatgataaaaatagaacaaaggacatagatttgcaaaatcacctgttaccatttttctgccatttgcttgttctcttgctctctctcttttgctcccgttctctc

SEQ ID NO: 338811 - DNA, 489 bp, Homo sapiens
cattttatgtacttcaataaattaaaagtataaattaatacttaaggttctccaaaacatctaatttttcatctattgtgtgccaagtcgtatgataaggactttacaatatttgtactgtcagttaaacctaccacacttccttaaattcccattccagactttttctcattttcatgttcaaaatgtttaaataggccaggcacagtggctcatgcctgtaatcccagcactttgggaggccgagacaggtggatcacctgaggtcaggagttcaagaccagcctggccaatattgtgaacccctgtcacaactgaaaatagaaaaattagccgggtgtggtggtatgcacctgtagtttcagctactcaggaggctgagacgggataagtgcttgaacctgggaggaggaggttgcagtgagccaagatcacaccactgcactccagcctgggggacagaatgagactctgtctcaaaacagaaaa

SEQ ID NO: 338812 - DNA, 439 bp, Homo sapiens
aatggagaagaactttctgggggcagagaacagcagatgcaaaagcccaaaggcaggaaagagtttgggttgtttaggaagtgccagaccagtaagttggagtgtcacgggcaagggcagagtggcatgtgacgaggctgggaaaggcaccgggtgaacacgaggctcccctcccaattcccctcttcttaggatcacagccttgcattgcctatttctgctgcctagaaacagttggctcataaattatttccagttttatagttgtttacagagacagggcttgtctggatacgtcatggccagaggctcatccagttgttttgaagattaactgagataatacatgtaaactgtgcagtacagttgctggcacatagttaatgcccagtaaaaagcaggaaagatgtcttgaaagaatgagtgtgaaaatgagatg

SEQ ID NO: 338813 - DNA, 633 bp, Homo sapiens
cgcccaggctggagtgcagtggcgcaatctcgggtcactgcaacctttgcctcccgggttcaagcaattgtctgcctcagcctcccgagtagctgggattacaggcacccgccaccgtgccaggctattttttgttttttgtatttttaatagaaacgggatttcaccttcttggccaggctgctcttgaattcctgacctcgtgatccacccgccttggcttcccaaagtgctgggattacaggcgtgagccaccatgcccggccagtttgtgtttttaatccctatgtttttctagcatctaagaaggaccaactccacgtaaacatcacccagttgacttgtgactcttgtcaactgtatcactgcctcaatcatagcacaatacaaacacacaacatatccactctaataattctgggtcgtatccctggattatggatccctgtcaatttgtgcaaaccttgggctgccacccctgctttacattttgtaaaactccttcttacccagctcactcatcgtgcacgtaaagccttaaacatagtaatttttactgtaatctccttagtcacactaataacctcggttgtagtgtcctcagtagcactacatagttctattcaaacagcc

SEQ ID NO: 338814 - DNA, 184 bp, Homo sapiens
gaagtaatgaaagaggaagaacaggatagggatggacagtcaacagaacggtgcttaaataacgttatcataacaagctttacttccaggaaactcccctggaagaaagagagtactagtatattctctgctataaaactcagccaattatattccagaatcaggaactcttgtatttagatgt

SEQ ID NO: 338815 - DNA, 537 bp, Homo sapiens
gttgcacatacaaaatgcagttgggagaagctgatgtatctgagatacttcaatagcaaagagtgattgtaactatataagttacgatagtgacaataatgagaaagatggcatccttcttcaaggaaggccaaattgacaaaaagctgagcagacctggcttcagaaaagaaacagtctaagtagagaaaaggaaatcctgcatcaatgtgggaagcgatctgatttaaatattttctttcagcaattacaagaaacacacaggaacatgatttaaaccaaaggaagagcaatcatgtttcctttaaaatcaatgctaatcacaaccacatatgcaatagcccctaggaccttggctagccacagaccaatgaatgaaagccacttttccaaagtaagaacacaaagcatcaacaagtagctcttactattcttctgcttaatctcactcacccttattttatcatgggcttgcttcatatgtagggcaaaggacaacttaaaaatcattattgtaaatcaacaagctataagtca

SEQ ID NO: 338816 - DNA, 264 bp, Homo sapiens
gcagacattagagtaaagggcctccaccacctgctgcctccacccccaagtcctctcctgtggttcctgcccttcctgggatctggtggttgagatttttcttggctcctggggcacacattttcgtgacaacctctgtattggcgagggctctttagttgcaaagaaatccacactggcttgagccaaaggaggaatggttggctcatgtaaccggcaaaccaaagcgtgctgacttgaggcatggctggatctaggtggttg

SEQ ID NO: 338817 - DNA, 285 bp, Homo sapiens
cccctggcaaacttctgtctttcaagtcctagctcagaagctccttcctctgaggagcctttcctgatgaccacagcacaggagccccatctgctagctggattcagactccctcatagcacttacactccagacggtagctactctgcttttatgtgtttgtgaattcttccctatacacacaatgtctagtctagcagatggttaaaatatgcttgaataaatgaactaaagagttaaaggacagagtgatctccaagcatagtgattcacactgggctttgg

SEQ ID NO: 338818 - DNA, 436 bp, Homo sapiens
ggtgcttggctgttgggttcagtgatccttacatctagccccagctagtggtgttctggtaaatcgttaaccaccaactctttgagcctcccggggtaatgaaagttacacctctagttagcatgtttatgaaatagatcccttctgcacgcgaagacctgcatgtagggcagtatggtggaaatggtcctgaatactgttgacggtccacctagaaggaacccgcccagaccaagtcttagcagtggggttcttactgaccaccttcttccctggctctcctcagtggagggaatggaaggctgtgccagctgtttcagagctttctcctctctgctcccttctctatagatgcagatgccttggctctacctgccactaatgatctcattgggtatgactttagatttttttttttttttttttttttcttttg

SEQ ID NO: 338819 - DNA, 407 bp, Homo sapiens
acattgaatcaggaaatttttctgagaaaggcaggtgggtatgggcaatctgacacgatccaaaaggcttactgccttgcacccctccccgcaaaaaggaagtagagaccaagatcttgggctttaattttatttttaattgtaaaaagatttcaaataagccaccatttgaactgggaagggaaactagggatggtcttgggggaaaatgtcattctctctaagaaagggaccccggggatgtgggtcgttttgagggtcctagaagttgaccccaattctcacctctcctgctgcactgcaggattgcccagggtaggtctagtcccctaggttcttcagaccactccaggtcaggtttggttgggtggctgccagtggtcttccactactgttcctgtctaggg

SEQ ID NO: 338820 - DNA, 261 bp, Homo sapiens
gggaatgtggaagtaggaggggatagcaagaaaagagactggaaaagtaaatgggggccagatcatggaaagcctagtactctgggaatttaaatttcatccttgtaaggactgggaagttactaaaaagttttaagcaaatgactgatacagtaaagcttgtgacactgaaagatttctctttgaagattccactgctaagaaaggtttgaggagttgtaaggctgaccagttaaaatcctattgacttaatccaggtga

SEQ ID NO: 338821 - DNA, 201 bp, Homo sapiens
cacaggacaggtccggcagaagggagggaggacaaagagccaaaagccccggctgcacctcctagcagggaaatggagctggctgtgagccaggttttcctctaaatcagaagcaaatgcaccaaagctgcaaccttaccccttgaccgaggacgggaaagtgcctgtctgacctcacgttattggtgctattatcatcat

SEQ ID NO: 338822 - DNA, 458 bp, Homo sapiens
ggtggctcacgcctgtaatctcagcactttgggaggccgaggcagacggattgcatgaggtcaggagttcgagaccagtctgaccaacatggtgataacctgtctctaataaaaatacagaaataaaattagccaggtgttgtggtgtgcacctgcaatcccaggtacttgggaggctgaggcaggggaattgcttgagcctgggaggcagaggttgcagtgagctcagatgttgcctctacactccagcctgggtgacaagatgacgctgtgtctccctgtccccttccaaaaaaaaaattgtgggcctttattttctgcctggaccatcaccttaagcttgatggatggaactcctggcacatttctacccaggatcctcccagtactcagttgttttacctgggagaagataccctccctgtcctcatcattggctgcttccagcctgagtcagc

SEQ ID NO: 338823 - DNA, 483 bp, Homo sapiens
taggcatgaaggaagaaaatgcgcctgaggacacagccagcacaaatgcagaggcatacaagtgcctggtacagctggcatgcagggatggctgaggaactgcgggggcagccggtgggatccatccgaggtgagtgatgagagctgcacggcaatttaggggatgacactagccacagcgtgatgaataaatcttaaatgcagaggtagcgcctggtggtgagcagttagaggctgagacaatagctgagaacacatgacaagttcagcaactaggagagtttctagttaattggaaggaagagttggaagcacattctagagggccgtggaagaataaacacaatccactaactgccgggaatgggagtgaagagtccaagatcacagggtcctccctggctgcctgatggggcagtggtgttgagtaacagaaatggaacaaaagaggggcaagagattattctttgtagcatgagtatt

SEQ ID NO: 338824 - DNA, 707 bp, Homo sapiens
gctgtactgagaaggatacaacatcacttctgtagtattcctgccaaaaatgtatactctaaatgattatatatgtctaatcatgagggaacatcagacaaaaccatactgaaggacatatatacaaaataactggcctgtgctcttcaaaaataccaaggtcatagaaaagaaagactgaagaactattctggatcataggagactaaaacacaaacatgatagctaaataattcaatgtatgattctagattcgattctggaccagaaaaaagaggttgttttgctacacaattcctttgtgacaattagcaaaatttgaaataaagtttacacattagacaatagtactatatcactgttatttttctaattttgatcattgcactgtgtaagagaacgcctttttttttttttttttttttgagacagagcttctttgctcttgttgcccaggctggagtgcagtggtgcgatctcgactcactgcaacctccacctccagggtccaagtgactctcttgcctcagcctcccaagtagctgggattacaggaatgcaccatcacgcccagctaattttttgggttttttttgtgtatgtgaatgtgtgtaatgtgaatatgtaccacatttttcctatccattcatccactgatgaacacttaggttgattccatatctcaggtattgtgaataatgctgcaa

SEQ ID NO: 338825 - DNA, 333 bp, Homo sapiens
caaaaagcaaaacttgaatttgtcacacactgaatactatgttgaatccatgaatctgaagagatgtgtaggcattgtattagatatcaaaagtcatctagagataatacatgggaaaatgtgggtagtttatatgtaaaactatgtcattttatataaggaatttgaacatccatgaattttggtacccatcgggggtcctggaaccaatcccccacagataccaagagatgactgtacttactataattacactaaactgaacccaaccatctgaagaaagatcacatctctacatattttcctatcactcccaaagttctattatgcttt

SEQ ID NO: 338826 - DNA, 446 bp, Homo sapiens
gctgccattgtgacattacattttgttaaaaatcaaagagagcaaagaaaggaggagagaaagtgttttgtgtgagactcccgtacccctcactttccagacaggtaatacagtactgtagtcccactgaagataacatagagacccaagttcctataggagctgtccaccaatcaaggtgacagaaagatgccatggaactctgggaaaaggattgctaaatgttggtcaaatctgtggaaaagccacagaataaagtcaggtgaccacagtggatttgtgttgtctctgaagaggctgagctatgtaacttactcatatgctggagcctcttctcctctgcagaaggattccattgatctctttgccctttttctgaaatatgaacagccaggtctgctggctacatgcctgcctgggctgacatgggcatcttttgtgcatca

SEQ ID NO: 338827 - DNA, 575 bp, Homo sapiens
aaatgattattttcataagactgaacaaaaagttaactaagagattcaaaatgatcaacaatcttagcagagttcacttaaagagtcaaaattatcaagcaggctatttgaaatatgaatactcatcaaaccttgcaccaaatgtatgttacccttcccaaggtgaaccagcgatggtagcacatgtgtgcgatttataaatgaatgcaagtacattgaaggagcctgctcaaaaatgtttacagaaagggcgtgcaatcaaaaatggttccagaacccggctctaattatgtgaaccctgaattgtgaagccaagacaaattgggattctcaattatttcagtacgtgtcggtcagactgcaagtatcttaagaggtggagtgactctcccaagttctcatggcgaatcctgcatttgattcagtcctggctccccacaagtctgcaagaatgggcaagtccattccctgtctgaactttattttctcacctttaccaaaagaagtttgaaagaggtgatcaggaagggttcttctgactcgaatgtttcataatcaggggtttcccaagaata

SEQ ID NO: 338828 - DNA, 233 bp, Homo sapiens
ctcatcacccactatgggatatttaggttgttctttacattttattactataaacagttctgcaatgaacatcttcacagatttatgtttactcagatccgtccctgtccctttataatatattctggagcacatttggaaggcctggacacacactgtcaggctgcccttctcacagattttatgaaatttcattcccagtaggactaattactaatgcatgggaaacaggt

SEQ ID NO: 338829 - DNA, 263 bp, Homo sapiens
ctgatgtcccctctgctgcactcctgccaggctctggagtcagaaggacccaggtccagtctcccctttgccttttactggccaggagtgcatgggtggccctttccttgttccctgtccatttcctttctcttatctgtaaaataaggaatgaggaggattcctgcttcagagtgagaattaaagggcccccaagaacgagaactggcatacagtaggtacatggtaagtagcagtcatagatttctgaaaagggatctttg

SEQ ID NO: 338830 - DNA, 679 bp, Homo sapiens
tctcgctctctctctcttgctgtctctctcgctctcttgctgtctctctttctcactcgctctctcttgctgtctctctcgcttttgctctcgctctcactctgtagccacatgacagtgtttaatcacagacctctccatcccttactgggattattgcaccagcctctgccagaattccctgaccccaggctcgccctgcttctctaaacttctcggcagtcagggtgagcttgcaaaagtggcaagtccaaccgtatgactgtgtccctttagcctgacgcccttccccagctccctatataatgcagagaaagttccagctccttagccgcgtagtcaaggttcctggagtcctggcccctaaggcattggtgctctctggttccctctccctgtgcacctcacctgccttccaggtgaggtgattcctggaaagtcttggccgtttggcagtgcccctgcagcccaggcctgaatagccttctctcaagatttggccaaaacatccccatctccatgaagtgtccacactgcctccccactttctcccagcctgggggagttgaccaccccctcgaggctgccccacttaggctgctgtgcaccaatgtgacactggtgtgacattgactgttacactgggggcaccgatttgggtcttagcctgtcttctcca

SEQ ID NO: 338831 - DNA, 188 bp, Homo sapiens
agaaggaaaaacaggccttaggaacttaagatttttgtctaaagtcatacagctgattagagtttgagatctcaattcaacaagctgatggaagcaatggctaatttttgttgggcattttactctgatccagagtaagcactaagcactttacaaacacaatcttaattaattttcacaatgatcct

SEQ ID NO: 338832 - DNA, 693 bp, Homo sapiens
gaggtgatgggagaagaaatgtgaaagaggaggacagtactacattcatccaacgtggacaaaaatccttgaggctagaaagaattcagtttcctatagtagaaagatataagacaataacagtggtttgacacataccaagaacttaaagtaaatgtaaagtatctaaaacttactttgtcacttcatgaaaggcttccatttaattgacagtcatgcacaagctcgggaatgaaaaggacataatcttaggaaaaccaaatgattttacctaaaagccagtcatcagaaatctgcaaaacacaattagagtgaaaaagaaatctactttgtttttaccctaaatatgttggttctgagatagatttacagagagatagtataaaattactagtatccacagaaaagaagccagacctagcttttcagacacatcatgaattgactattaaacataatattcattttgataagtgctttaaattgtttctctgttatagccacatgtgttcttagtcctcagagtatattggcattttacattattgatcctcccccctcttttaaacttctgtgcagcccattatcctgattcttctaactctatgagttatactccaaaccacgagccctagagcagtcaacccccaagaacttgttcactcagttttacttccacacagatgactccca

SEQ ID NO: 338833 - DNA, 490 bp, Homo sapiens
ccaggatacctgttagacaagtcttcagtatattcttttggctttgtcatgtcaaccacataccttggccaggtctctgatgatttccaaatgtttaatcatcctaatttgtgatatccttgttctgtcacttttttagtatcttcagcctaacgtgtcttgaataggtctttggtctgtgcttataatcaggttagtagtcctgtcgtttttccctcctccaataaatctttcatattttaaaggaaaagcagcttccttgttaaaccaatcataacaaaagccccacacccttatcccaaaccttcgtggttaagattaatgatagctgaaaatcatatacccgtttaataattatcttggtaatgttaataaaaattttaattgttttcattgaaaaaaatcaaatatgaacaatccctccctgcctgtgccatttaggtcacttactcatcctggaatcccctgatcttcttcctgtccccatctc

SEQ ID NO: 338834 - DNA, 240 bp, Homo sapiens
tttggtctcctacaagggcaactgattatgttcagcattaactattactatccagcagtaaagaattcagtattcccatgagatacttttcttcctgaaaggcacctagacctccttccaactttaaaagagaagggaggtatatgtatgtttttaatcttctcctttacagtcttaactaaaaaagcctaactactatttacatggaccacgtgccttacctagaaacaatctgcagaa

SEQ ID NO: 338835 - DNA, 542 bp, Homo sapiens
tgagtgaagccctcgaagtgagttccttttctctttcagttcaaaaatttctctttatcttcaccttctccttccttccctccagtttctgagaaggatgcattctccctgcttacaaggcaaatctccctcaacccttgctcttgttcctaccctgcttctaggttctcacttcatccatcatccctttctgacttgcctcgtaagagtcaaatcatgcccttgtctctccattctggaaaagattctcattcccctttgtattcccctagtctttctccttcccttcatgcccagacttcttgaaagaatagtgtctctacatgtagcctccacttcttcttcacttgctcatttcttcatcccttcccatcataaaaataatagataacatttattgcacacttactgtgagccacgctctgtacagttgacccttgaacaacataggtttgaactacacaggtccacttatatacagattattttcagtaaaagttacagcaagtgtgcctgactctcctatctccctttccaccacc

SEQ ID NO: 338836 - DNA, 163 bp, Homo sapiens
ccactcagtccagccttcctttgtctttctcttagatccccaggaaaaccttctaatttgtctctgctttcactccacttgtcagtcagtctttttataaaaccactgtgattttgcccaccacttaactagaactttttggtgacttgaacttcaaaaatct

SEQ ID NO: 338837 - DNA, 401 bp, Homo sapiens
acaaaattgctttgggtaaaatggtgcaaaggtctcattcatttcaatgagctgttgcttattaaaaataaaatgcatttacaatatcaacaagctcctttttaacaagggatgctgttatctttaaaatttcaagaaattataacacttatttgcaagttacattcactattcttaaacaatcctaggttctattttactttaaattcaaacgttattgtgaatattatttatgaaattctattgtacatataatgaagaggcttgataaattaactaaacattacaccacagattttcagaaacatattgtcctaagcagtgtcaaaccaagggtggaggggcaggaccaagagaacagttttactctgcttgtgggaaataagggagtgtgttttagg

SEQ ID NO: 338838 - DNA, 569 bp, Homo sapiens
agcctcctgatatttcttggaaatgccaagattcacccaccttaaaaaccactttgtttttctgtctttgaaagagacatgcgctgtagatatttgcttgctactctacttaattctagacatctcagcagaattcttttgagaggcagacagtcactctggatctgcattcaaatttcaccctagaacttatccgcatgttaatactgcgtttctttttttaatttttcactgcctttctcgcccaaaaagaaagaacgtaagctcttcctgtcagggacagctatttttttttctgttttctctttttcttaacctggcatgaagacacatttctggcatagagcaaataaataataaatatttgttgaatctagtaggtttgaagaggcagctcattatacgtttcgtttgcatttctttaataactaatgatgtcgagtatgtcgagaatgttttcttcagtattctcagtcaaatcttgcataagttaatccttaatttgtcaactgttgattcattttgctctgtgctgttctcatgatagtgaatgagtctcacgagatctg

SEQ ID NO: 338839 - DNA, 491 bp, Homo sapiens
attaaaaataattcatattcctacctacattaagcattttggttcatttgagatcattctgtatatagttttgtaatttttttaaaccatatttacttggtaaacattcagtggatatatgtgatttatcattaggatatatcattaccagattatgtaattgtagtcattgctggatgtcttggaggttttctgattttgtagacaactcttgagatgaacatctttatgcatcaatttttagttcctgaaggtggaattagagccaattttcttgtgcaaagttcatgtcagtttctttaacacacctttacctacactgggcattatttggttgccattttgataagtaaaaatggtacttttccttacttctgaggcataatcagattggcatttaatcaaactattacatacatgtggtagaattcattttttttaaatttaactttgttgttgttgagagggagtcttgctctgccgcccaggct

SEQ ID NO: 338840 - DNA, 565 bp, Homo sapiens
ggtctcttaagaggttccctccctcaagctggaaaaagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttttcca

SEQ ID NO: 338841 - DNA, 474 bp, Homo sapiens
ggtctcttaagaggttccctccctcaagctggaaaaagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgccaccacaccttgccatttttttttattttaagtagaaacaaggtcttattaatactatgttgcccaggctggtcttgaactccagcgatcctcctgccccagcctcccaaagtgcttgggattacggaagtaagccactg

SEQ ID NO: 338842 - DNA, 427 bp, Homo sapiens
ttggaaaattgttcatctttcttatttcacctttttgaaaacgttttctaaaccaatcatctttgtaaaggatgaagaggtataaaaaacttgaaactgaacagactgttgtcactttgaagatagtaaatagagcttcaaaaattctctctaaattgcatttaagtgtaaatagcaatgcgtctgttaacaaatcctttgaggagaaaaacattttaacaaaattagacagttaaggagtaggttgaaaaatttgaactttttagttgggtaatgcttgagggaaaggggcatttagtggactggcttagtaagaacaaaggttctatctcttctgtgcacacgaatctgaaaggcactctctagcctgtatatcctattgtggttgtaatttggcaatgatgagagaatggactgaagtggaagt

SEQ ID NO: 338843 - DNA, 507 bp, Homo sapiens
atgtatcctgttcattgagttgcatatgctgaaccgtcctagtgaccaattattttaaaagagggccagaggctgaggcaggagaatcgcttgaacctgggaggcgaaggttgtagtgagccgagatcgcgccactgcactccagcatggcgacagagtgagactcgtctcaaaaaacaaaaatacacatacaaatacaaaattagccgggccgggcatggtggcgcatgcctgtaatcccagttacttgggaggctgagacaggaaaactgcttgaacccaagaggcgaaggttgcggtgagctaagatcgcgccattgcactgcagcgtgggcaacaagagcgaaactccgtctcaaaaaaaaaaggagataaaaaattagttactatcacaggattgttgtgaagattaaaagaggacagtgaggaggaattgggttctgagcgagatgagtaccgggagaagtcagagagtgggggcagtgaatattgaaccggatagcttgc

SEQ ID NO: 338844 - DNA, 221 bp, Homo sapiens
ctgaacgtactaaagaagcaaatatttagaaaaagttaaggagctggaagcatctcatccgggttgggatgagtggtggtgggtggttcatttctttaggaacctgagtacctgagggagaaagctcagctgggaactggagttagaaggaaaaagtatcaagagcactgagtgcctccagctggtcctaaagctgataagcctagtcttctggggagagg

SEQ ID NO: 338845 - DNA, 100 bp, Homo sapiens
gggaaataggaaaagcttgtaggaaaattggccagctgtctcagtagagtgtaagaagatacagttattgtaaaacagaataagaaatctatacaaagag

SEQ ID NO: 338846 - DNA, 267 bp, Homo sapiens
tatggtataatgatatgaatacagagtttgataatgaggcatatgaagaaggatggactttttaaaaactgtattttcagaaataaaatacaaacttatgcccccttatgtactttattattgtggttttaaaactttaggattttttccccacagatatgaaaattttgaggatcctatgggaactattgataagtttcactatggtactcactattcaaattctgcgggggtcatgcactatctcattcgtgtagaaccgttcac

SEQ ID NO: 338847 - DNA, 929 bp, Homo sapiens
agtgatgtgatctgggctcactgcatcttccacctcctgggcttaagctatcctcttgcctcagcgccttccaagtagctgggactacaggttcatgccaccacacctggctaatttttgtagagacagggtttcaccatgttgcccaggctggtcttgaactcctgagctcaagcaatcctcctgcctctgcctcccaaagtgctgggattataggtgtgagccaccacgcttgaacccttttttccttttatactgagagcttgcataattagttccaatgtacaactaagttttcataccatcttaactgtaaattctatacaaattcaacaggactcaattatttacaaaagctaatgtgtgacaacttgatcttcttacttggaatcttcccttctaaaatttgatttatcctgaagtgtctgcttgacttatatcctgtgttgctgctggctttttccatgtgcattttttgcaagctgctctttttacttcagtctcgttaagtcttgcagttctggctagaggcctactgccatgaataagctgccgctccacagtggcttctttgaagtcttagagtcagatgagtttcacggtgttcaggtttgtgatccagtgtggccccaggttctgggtaacacgtgtgatgcagtgctgtgtgcataccatgtcgtgaataacattcatgatgcagtgcacataccgtgttcaagttaacagtcctggtggcatctgaagtagcaccctaaaatcaaatgacacaaattctgcagagaagcaagtgaagtctaaaaactgagttggggtagtaacgataaatagcgttatgctagttcaggttatgttttgttgccaaatgaattacaaaaaactaccaggtttcaggcttttatgggtttcacgaatgcaggggagggatcgtg

SEQ ID NO: 338848 - DNA, 483 bp, Homo sapiens
tatgccaaggaatgaacaagaacagcttgaaggttagaagcaagatggagtcagttaggtttgatctctttcactgtcatagtttcctcagttataatttttgcaaaagcagtttcactttctagtgtctaatattttagtaagtccttctccttcctcccattttcctacctttttgatcctttctctgtgctacttgccaaagtgtgccaatttcaattcactcatttattcaacaactactccttgagcatcatcatgcacaaggcactagactaaacactaaggattcatccgtgaagaagacagacaaaaaaaaatcttgtctttgcgaagtttacgttcttgtgagaggaaggcaataagcaaataaaagagtaaaacatatgagtcagatggtgcccaggagaaaagtgatgaagagaaggatatatgaaatgcttcttcgtatgctgttagggcaggggagagagttaagttttg

SEQ ID NO: 338849 - DNA, 141 bp, Homo sapiens
ctggcgggggcgctgtctgcataaaacggctttatggccgtttctttttattatgattctgccagaagtcagcaagtgacatttcattaagaaaataaagtttaatgtgctgggaaagaggttggagcaggctggggcagc

SEQ ID NO: 338850 - DNA, 350 bp, Homo sapiens
ctgtcagaataactagaatttgcaatgagagaaaaattaataaaaaactgaaaatgcagtacatttcttcctccccatttctgtccactcctagtacaaatatgacccattttttttaaagaagcctgtggcaaataagatttgtaggaaattattagcaagttaggaaattaggatttatgtgaattacctgactgtactgccatcattaacatctcaggttccagtagagtcatgacggattcttccagaaacaaaaatccacaaatataatgaagaaagtcaaagtcacaggagaaaagctgtcttgaaagctttcacaaattcaatctgatgccttatgctcaaat

SEQ ID NO: 338851 - DNA, 2123 bp, Homo sapiens
gtgtaatggatttaaatttttaggtatctttgtctactttttcataaaatgaaagaacctggctgggcgcggtgactcatgcctgtaatcccagcacttctgggaggccgagacaggtggatcacgaggtcaggagttcaagactagcctggccaagatgctgaaaccccgtctctactgaaaatacaaaaattagccaggcatggtgtcatgcacctgtcatcccagctacttgggaggctgaggcaggagaatcgcatgaacccgggcagcagagattgcagtgagccaagatcgcaccactgtactccagcctgggcgacagagcaagactccatctcaaaaaattaaaaaaaaaaaaaaaagaacccaaatggcattttccttgatgtagtcacattttttgtgatgataatgtacaggatatctagcaattatgctggacatataagcacataagatttatgaaatgattttggataatgtataaggtactggaatctggcactttatttgctacttattttcagcactttatttgctattttctgtctctgatgagtagatccccatttgtaccacagtattaatttttaatttttcttgattatcattataaacagaatcagaggcagcactgagttttcaaattactcttgctttgcttcacagttccgtagagatatctcaggggtgcctgtgagcagatgctgagtgaaccctgccccagtcttgtccctacctctaccccacctctgtatcatagaaagagaaccagatgttttaggttcaagtcctgtctcttatatttattaactgtgaaaccctatttcacttctttgagctttgattttcatctttaatgataattatttcagtagatgatgatgatgatgatgatgatgatgtaatgttttaaagtgctaactatgtgccaggcactgaattaagtgtattacaaaatttaatcctcataaaagcccttgtgaattatatggactgttactactattttatagatgaggaaattgagacttagattctgtaactatttttctaaaaactgttctgtgtcggaaatgaaattcaaattccgggcagccaaataccaaagcttgaattcttagccatgagctttatacctcctctgcagaatttttgtgaggattgcatttgctactatatgtggaaggacttcataaaatatgaaactctgtactagggatgccaattcagttgcattcccagtaacatcttaatctattggtaactactgtatagaaagcactgtgatgagaaaagttttttgtgtccacctcaggcgggaatgagaactgagatcagttagtagtatctgctgtgggtatgctttgtccttattgtgttacacatagtattattattattagactattttgcgtagatttattgaattgcttttatttctagctctttccattttctgagcattttttcctttggaattgaattcaggcttacaagtacattgaaaattttaagaaaacaattataaggaaactaaaccatttccccattgtagtaaagtgtccttaaaaataattacttgaattattaagctagagtgcctcagaaatatatttgcttatactttaatttttcttcttgaaagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggtttgtaacacgtatgtgtgaaagaattttggccaggcacggtcgctcacgcctgtaatcccagcatttttggaggccaaggcgggcagattgcctgaggtcaggagtttgagaccagcctgactaacatggtgaaaccccatgtctactaaaaacaccaaaaaattagccaggtgtggtggcgcatgcctgtagtcccagcttctcaggaggctgaggcaggagaatcgcttcaactagggaggtggaggttgcagttagccaagattgcgccactgcactccaacctgggtgacagagcgagactccatctc

SEQ ID NO: 338852 - DNA, 396 bp, Homo sapiens
tcactgttagaaaatggtcactaatagttccttagtaagtaaaacctctgaacggcagttcagagaaatctgcaaatggcactgagaaatataagcaaaaatgctcattttcacttataagataaaaataaaagctaccacgagatatcatggtatctcactatcagactggaaaaaacccaaaagctgacaacaaatcttgactgagggtgtggacagacacacacacatatactgctgctggaaggccaaatatgacaattcctaaggaggggaatctgttaatatctaataaaattatgtatgtatttacccttgatccaacaatcccacttctaggaatgtgtcctagagacacagctccttaaacatgaaacagtatacagttattcactg

SEQ ID NO: 338853 - DNA, 395 bp, Homo sapiens
aagtctacgtgttttcacttaatcccccttaagtccaggctggtgtagggagacagcctttcttcccccttctccaaagaatgaagcctaactctggggtgaggaaaggagggtggagtagaaagggattgaagagtctgactgtgtcttaaacagatttcaaaccatccttattttagtttctcactttgcccccacttccagaggcacctagtgcctcccattcctgagctttttgtgaatactgtgttgcaaatcaagttgattcttcacctttcccatggatgacttaaacccactgatgtgctaagccagctctcattcttatgtctgctttccaaacccagactttgtattgcctcctctccaatcctccacgtccttaaagctctgtc

SEQ ID NO: 338854 - DNA, 212 bp, Homo sapiens
agggggatgaggagggcaggggaggaagaggaggcagtcacgctagagcctcgactgtatgggacagttttctgaggcgttcacgtttagggactgactcgtcagtaccatttattatgctgttgcagaggaaactgatgcccagcactgctggctgcacggtgaagcactccatagtatgattattgctatcacccttgtgtcatcctcct

SEQ ID NO: 338855 - DNA, 441 bp, Homo sapiens
cctgagcagcgggctcatttcccatgagcaggcttgctgtggcaggcaggctcacctgctagaggtggtctcctggcttagaatgggagcacacctgtgggaatcgcagcgcttctctacctgagctggatgtagattgtttgaaaatcctagttgtgcactgcgtttccatcgatccctttcatgctcccacttgttcctttagttccaaatagcaggctggtgttgagaattctgtcatcatggggcgtttttttctaaatgtgagaaatgtcggaagcatgggtgttctcagattgctttagccactgatgattttccttttagtgtatggaaagaatgattttcttctcaatttctcccctctaacctcctgcatgtagatttatggattctaatcgggacctttctttgattcagtgccaggtacacaggccccga

SEQ ID NO: 338856 - DNA, 419 bp, Homo sapiens
tacctggcagtgaatagactgcagataaatctatctagaaagataaagttgaggatcgatcagccatgccttttatgccaaattaagaagttggagcattttttgtttaatttaggttgaaaaacaattgaggaaattcctttaaatgggaaggacatgatcagatttttatttcagatcagtttggcatcattctaaactagctctgtccagtacaaaaaaatacaatgggaagcaaaaatgcaaaccacatagtaattttcagtgttctattaaccacactaaaataagaggaaacaggtgaaattaattttaacaatatattttacttaacccaatctatccagattattgtttgaacaagtcgtcaatataaaaattaatgaagtatttcacatctttttcatagtaaatcttca

SEQ ID NO: 338857 - DNA, 649 bp, Homo sapiens
catattaatcttcaaaaagcacagctctgattacatccctcccccattcatttttgcctaatgaattagacaaactgttcccattcgaggtcctccacaatccatcctagtccatccctcacaccacctgctccagccaagcaaaactgctgctctctgttcctgattacatctcacccttccctcatctccccctttactctcagtcttttctcctccctgttcacatccctagaagccactaagaaaaacctcctgtgattgctgtctatgggtaggcagaaaactccccccaacaaaattaattcacttcctaatccctggaaactgtgaatattatcttacatggcaagaagagtattaccttacatggcaaaagatatgactaagctaagagagaagggatttatcctggagtatccgtatggattctcggcgtgtgcaactgggattggagtgtccagatgcttttaataaaaacaacccccactgcagtctcaccctccaagtgggtatggagactcggcgtgtgcagcaacaacttcgtccaccgggacttctgatgctaagatggagtatggagcttcggcgaaacaccacacccgtgtaccaaggaagtcgttatggacgaagttgttgcaggtccgga

SEQ ID NO: 338858 - DNA, 413 bp, Homo sapiens
aaaacaaaacaaaacaaaacaaaacaaagaagatttggtagaattctcctgtgggagtttggagaaagaagtagaacattattattgtttttttcctgtcatatttctaatggaaacaggatgattacaagagtgcaggggaaaggttggggaaaagaaatgtgacttctttcacttttacattattgaaattgttatttaaattgtattctataaccataattaaatcttcataaacttttcacttaatgatcttagcattcattgatggtctttgcctgaatcttatttcaaaaggcaaggcatttcaaaaatgctgatttttaaaatttctatcatttcttatacacttattagctcacatttttctgtaatgagtttacccttatcaagtgggactctttggttagctg

SEQ ID NO: 338859 - DNA, 514 bp, Homo sapiens
ccatgtcacaactatggaaaacttggcaggcaggcctgggtccaaaccccagctctgctgtttacaggcttggagacattcaccaggccatcactcttttgcgcctcactgctgtgtctgtggaacaggcaccgagcaaatggcccggggcactagcgcttcccgccttctgaaggtggggcttgaataagaagaggaatgcgtggactggagggaacaagcatttgcgtttcaggggaaagaactaatcaaacatgtcaaaactcagcagtggaaaagagacagtaactaccaggtgattctgtcacgttacttcatgggttttgtaggctgaatgcaatgtgtctttaagcacagcttagcctgcagtgaaccgtttatatataaactgatagaattcagggaactcctattttcacaataaaaataacaggctttatcaggagaattgtttcaaagagcaaaatcagacaagcatgagtgtgtgttatcagaaaagagacaggtgttctca

SEQ ID NO: 338860 - DNA, 81 bp, Homo sapiens
atcttcaaaatatttccagactctagccaataaccaagtccaatgatgttatactattccaagctaccattgttcctcatc

SEQ ID NO: 338861 - DNA, 465 bp, Homo sapiens
ctctcatttcaaaattagggactggccttaaaatgctgacaccattgtgaggggtgagggctcctgcagacacctctggactgactccaactcagaagactcgggctctgcggtctaagggacacacggtggcttggtgatgtcccttggagagtggtgtcctccctgggaagccccaggagctgccctgtcctgcccccagtgtcacctgccaggctaactttcagtaactctataattccgtgatcaaaactcatccaaggtataaatcagtattaccagattctctttcgagagaatgttttgctaagaaagtgatgaaaaaaaggagaatactactaaatgcctcaaagtggacaggagaaaaaaagacatagaaataaggacacggtcctttgaccatcttcttgttttgtccaggactatccgataccccatcctcacagttaggccaatgatcctcat

SEQ ID NO: 338862 - DNA, 103 bp, Homo sapiens
gggctctatttttttagagcagttttaggtactcaggaaaatggagtggaaaataacagagttcccatatattcctttccctcacaaatgtgcagcacaccct

SEQ ID NO: 338863 - DNA, 435 bp, Homo sapiens
tgggggcttttaaagaggaagtgaagggtaactcatctctatcctactttacatgccccacctaagtccaactcccactgcctgtcttctaagggacatcttgtggcttgttctctgctctgctcgtattcagtctctacgtccctcatgctttctcatggatttacaatgattacttactctcaaacttatatttccagccctaacctctccagtgatcatttgttaacaagattgtgttaaaggaagcaacaaaggttcttctattggatgtagttgaaaaagcagaactgttgctctggcctaaacattaactttggagaggtttaaattctgtttagaagttataaatgagcttaatatcatgtgatttgcatgataagttattttaaagagtttaaatccatgattgttcaaaataggttgttttatttt

SEQ ID NO: 338864 - DNA, 277 bp, Homo sapiens
aggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgag

SEQ ID NO: 338865 - DNA, 648 bp, Homo sapiens
cctgaaacgccgtatacatacaaatcatgatggacgaagtgtgcgcaacaacttcgtccatggtgattgctcagtatgggcattcggcgtgtgcagcaaggacttcgtccacacggacctgcaacaacttcgtccagcacgacttttctgcgtctggtgactcggcgtgtgcatgcacacgccgaggaaccatacacacacacacacaccatgatctagttatcaaaaaactttttctgtcatttatcagctggcttattaaaataaatcaatttttccctagaaaatccttagtaattctccacattgctaagatacaccatagcaagattctggatggtgagaagttaatggtccaaagtaccgcaaccttaatagtccaacctatcttcaatactttttacaataaccacacaaagtggtccctagtgaacataaacccttaagtgggctgaggaaacttatatgtcttcttgatagaactttctgcaatgatggaaatgttctctatctttgcagtccaatatgatagccactggccatatatgactatttaaacttaaaaattcataatgctcaatagtaacacgtggctagtagcaaactgtattggaaagcatatttacggccctctactcagtgtggtct

SEQ ID NO: 338866 - DNA, 496 bp, Homo sapiens
caggagggagggttcacgtgtgtgtgtgcaagggtggatggtagtagtggtgagtgatgagaggcacacagagccttcctgggtttggaaatcatatcacaatataaaaccagtctagtatgtatgaaaggtgatctggtcacttctttactctagagaaagggccagagttagtgtagatgcatccttatgaaaatgtcatctctctaaggattgcaggagcaatgaggaaatataattcatacaatctcctccagggttttagacctcaagataggccagagagagattaaggaagccagtagtaaagctaattgtggtggagatttgcctatcatggtgagatcctgcatagagatgtctgacatagcatcttaaatacagcatccaaagaatggaatgttcctgttcagggtcaggccttttaagagcaaacctactggctgggcgcagtgtcagtggctcacgcctgtaatcccagcactttgggaggccg

SEQ ID NO: 338867 - DNA, 579 bp, Homo sapiens
ccaggctggagtgcaatggcaagatcatggctcactgcagccttaaactcctggcctcaagtgatcctcctgcaccagcctcatgaataacagactataggcatgtgctaccatgctcagctaattaaaaaactcctttttttggtagagctggggtctcactttgttgcccaggctggtccggaactcctggcttcaagcaatccttccaccttggtctcccaaagtgctgggattacaggcacgagccaccatgcttgggcacatggcagtgtgaaagctagactttttggtccttggtatccttgacctaatgtgctagaatcaggggttgcacgcccactcattggccaggtcacatgatttacgcaggaacataatttacggaatgggcagggtttgagggacacacaggtgagtggaagggctggccctgctctagcaggttgctgggatgcaggaacggggaggttgtccaggtcatggcagcacgtcctctaccaagggatgtggacaccagcccccgagcactggctgggggagcagtgggttgccttcaccagccaaggcaggaacttg

SEQ ID NO: 338868 - DNA, 578 bp, Homo sapiens
aaaggatggggacaattaagggctgtttcggagaatttcacttgccttatccactatgatggctcctatcttattggccaaggaatcaatgttgagttctgccaactcccaagtctgtccaatccaagtatacattcaggtactggcaaaatgaccactgggggcattcatggactcagggaacacaccatagccaaacctgagccaggacttcatttattatgtagctcccactgttcctattctaagaggtcatgatgacaaatatcaacaaatattaattttaattcaaattctgtgtccaatagtccttgaaatatttaggtattcactgtcctcctgtgatgagttactggattaaatggccatagatagttttgacaaagcacaagcaaattattaccaaataatctcaccatgatattggagtcttcctgtttatggcccaggctccccttcattcaaaaagttctgaatctgaaaattggctcagattcagaaactgggcatctattctgctctaagccctaatcaacccttaattgttgctgactatataaattgaacaatactgttgt

SEQ ID NO: 338869 - DNA, 261 bp, Homo sapiens
gagcagggttcattcagagctggggtctgcctgactgagccagtactctctccattttaatagtttaataaaaattagcataattaacgaacatctgtatgatccagagtggtgcaatttggcacttggaaacgagggcttaaacatgattgctgtgagtttaatgttgttttaattctttttggcactgtgcagtgaaataaacgtttggtggtgatagttctcggccggatctcatttgcatttttctccctttgatta

SEQ ID NO: 338870 - DNA, 590 bp, Homo sapiens
ctcccaggttcaagcgattctcttctttcagcctcctgagtagctgggattacagctgcgtgccaccatgccctgctaacttttgtatttttagtagagacagggtttcaccatgttggccaggctggtcttgaactcctgacctcaggtgatccgctcgcttcgacctcccaaagtgctaggagtacaggcaagagccacagtgcctggcctgtttatgaagattttataaacagatttctaaattcagaaagtatttaagggatcccctctggtggcactttaattcagatggggtccacaaaataggaaaatatttactaggaaatttgaacaatcttgaaatcactgaaaatggtgatgtgattctccagaaatttctgattgggaataagcactttgaagtaattggctatcttattaatctgctgttcctgaatttccccttagtagcggacatgctttattgtattaagttggataaccaccttagtagcaaagatgggcttgggcttcagtctggtcaataggcatcttattcaggtagatgccagatgggagggatggggacagcttagtgaagaaggatg

SEQ ID NO: 338871 - DNA, 310 bp, Homo sapiens
ttagtccctgccctcaaagagtttacagtcttgtgaaatccaagacttaatatgggacttagataacatttacattttacagttaaattcacaattaatatgcatgatggttctattttccatgagtcacaacttaccggtcagcctctgctgttattgtcacaggtaagtcaattgtccccatggccatttactagtcagatgggataataaaaactaaatctgagatgtgacaagtcttgggtagagtacaatgtatggtcctctctacttcacgctataatcacactattgcactacagcctgatac

SEQ ID NO: 338872 - DNA, 255 bp, Homo sapiens
gaggcgctgaaacacttttaagtctctccagggaactgccgcagtctctaacctttcgttcacacgcccctgatggtggccattggacttcgcttcccggcaagcctccgcagactggcctcacagagggtcaggtctggactattccccagcatgcttggagctcatgggcgatcccgccccctcagtcaatggggaggatacgtcgaactccatttcccagaacacaccagggctcgctgtggcaactgcact

SEQ ID NO: 338873 - DNA, 335 bp, Homo sapiens
ctgttaacatcgacggtttctcatttcagatattttatctggctggtgtaatattgtacatacctaggctatggcctgcttttgccacttaagacgtttcccatgtctttacaagttttcataaaacagaattcaaaaaatggctaagcagctagactactgtgtaagtatatacaataggtttcttaaacattcccaaatagtggatgatccgattgtttccaattttaccatcttataaataatgcttatcaataaatgtaggcacctttatgtgtcagtctgtccttctatcgacttgggataagtttctcttttttttttttttttttttt

SEQ ID NO: 338874 - DNA, 235 bp, Homo sapiens
tgggacactggctaaaggtaaaaccagcctaggacagctccctggggcctgagggtctgcagatctggactcccttccaggcctccctccctccaagccagcttccatgtccactgcagaaatagcttccactcagtcccaaacatcatgcctacaaaataaacaagaaaatatgctatggttggcatagaaaccttccacagctacctttctccgtatcctcaccacatgccat

SEQ ID NO: 338875 - DNA, 228 bp, Homo sapiens
agttctgcaagacattctaatatcctcctagacatttgtacagaaaattatgtataataaaaattgctacccacccattatcacttatcttaacaatagttttgctttaagttacaagtttgcttgtatggaatggcttctcatcttctaacttctcttaaatttgaatttattcattttaaaatagcataacaatttagttacttgagtacgtctctaggttagttg

SEQ ID NO: 338876 - DNA, 362 bp, Homo sapiens
atccagacaaatcttgcttgtcctggaaatgcttacaacataataaagggagaaagatgaataaaccaacaagagcagtaagtctcaaaaatggcaaattgctgtgatcacttgaataggtcagtggagtcatcgagtcatgtataaaggaatgtgggactatgaagataaacagtcaatgagaaaaatagtgcatataaaccagtaaaagtcttagtggtaaagtgttcatgtaatacttcattgataattaacaattttcattgtcacattctatattgtatctaattcattagtttattcagtattaagtgcccctgtgtactactgtttattaagtggcactatgattagggaaaaac

SEQ ID NO: 338877 - DNA, 950 bp, Homo sapiens
ccatctcatctcctacccatctccaaaaaccaacagcaaacctccctatgtcctcaccctcttctctgatgatcctctcaccttccggctaggtttgaaattagtctccaggaccagggctctcccctgtgaatcctgtaccacttggacaggcagtgagctaggtgtctgccctcctcactgccacttcctgccccttcctcctccctagagaaacctgctttccaagtcactcctcaatagccccctagcaacaattccctcttgcctgcaccataattttcccctttcctggaccattcccaatgcacagaaacatccagtattttccttgggaaaatgacatgttccccgaccccactgcatccttcaactaccacccacttctttgctccacaggaaaaatcactgagatggccataccatctccatcttctttctattctcccctgacttcaatcaggcctctgaccccatccagccaccaagactgctctcgtggaagtgacaactgataacctccacgggtaatctgctcttaacttctgagacccatcaacagtactgggtcccatccccttcctaaagcactctcttccctcactttctggggcatccttctctcttggttctcctcctccttctctcgccacgcctctcagctgtctttgccggcttctgctcatcctctaaacttctacacacctagagaaaaccagaggtcaaaccttggacctcatcttgacgatctcatctctctcctatttcctcccacaaactctacagtgttacgtccaactgctttcctcacatctccacttggatgctacctggatctcagacttcacgtccacactgaaatgattttcctccctgaacctgctcctcccacagtcacttaatggcaactccacctctccagatgctcaggtcgaatgccatgaggcatc

SEQ ID NO: 338878 - DNA, 281 bp, Homo sapiens
gtggtgctgtcttctagtctttccaagcatgaactgggaggagctggagaaggctttgcaaggcttcccttgggttgggttgcactgcccaggcaggagggaaaggcagcattgatatattgatcacctgcgacacatcaggtgctctcatgttcgtttcccgcttcatcccctatccatgctgccggatgggtggtaactgtggacagatggaagcagagactcagggaggtagaagggcttctctgaggtcacacctggctgcacctggtttgctcccc

SEQ ID NO: 338879 - DNA, 245 bp, Homo sapiens
atcgtctagaggttactgtatccggggaggggcacggaattcactcttgttaccaggctgagtgcaatggcagcattgatatattgatcacctgcgacacatcaggtgctctcatgttcgtttcccgcttcatcccctatccatgctgccggatgggtggtaactgtggacagatggaagcagagactcagggaggtagaagggcttctctgaggtcacacctggctgcacctggtttgctcccc

SEQ ID NO: 338880 - DNA, 319 bp, Homo sapiens
gacacagatttaaaccatatctttctcccctgaccccacagatctcatatccttctcacattgcaaaatacaatcatgccttcccaacagtcccccaagtcttaactcattcagcattaactaagatgtccaaagtctcaggtctcatttgagacaaggcaagtcccttctgcccatgagcctgtaaaatcaaaaacaagttagttacttccaagatacaatgaaggtataggcattaggtaaaatactccagttccaaaaggtagaaaacagcaaaaaagggggttacaggcactatgcaagtcagaaacccagcagg

SEQ ID NO: 338881 - DNA, 483 bp, Homo sapiens
caaaaaggtaaacaataattttcaagtgtgatagttcaaattcctctgcgagatctactacagagaaaggttctttgacatacggattttctttaaaggaattgatgtaaaaatttaagtatgtctgggagaagctgaaatcactctaggacttcactccctagcaaataaagtgatcatttacttggactcataggctattaaattattgaaagatactgtacaaactatggcactgtcacttttaaaaaaatgtttaccactctatcttgtgccggatcttcacagctgtgacatggtttaaattccataatccatccccaataggagcccacccaaagccaaaatcaaatttatccatgcactataagatgatccatcttaacctgatacagtcatcatactgtagtttttggaagggctggttctgcccaagagaaattcgtccttacagtttattcagctgtctaccatttgtatgtc

SEQ ID NO: 338882 - DNA, 783 bp, Homo sapiens
cactcttccgtgctgggaatataaaaagtgaaggaacaaaatccctgttctaggccgggggcgatggctgagacttgtgatcccaagcactttgggaggccaaggagggtggattgcttgagtgcaggagttcaagaccagcctgggcaacatggcgaaactctgcttctaccaaaaaaatgatttcaaataaataaatcactgtcctcgtggaacttataaatatgtagtgtgtgatgatgataaatgctatggagaaaaagcaacacagatggggatcgagaggaagttaaaatttgaaatatggtcgtcggccgggcgcggtggctcatgcctgtaatcccagcactttgggaggccaaggcgggcgaatcacctgaggtcgggagttcgagatcagcctgaccaacatggagaaaccccgtctctactaaaaatacaaaattagccaggcgtggtggcacatgcctgtaatcccagctactagggaggctgaggcaggagaatcgcttgaacttgggaggcagaggttgctgtgagctgagatcacgccattgcactccagcctgggccaataagagggaaactccgtctcaaaaaaaaaaagaaacatagtcgtcagggaagaccttactgcagagacatgtgagtggagacctgaaggaaatgaagagggaaggagttgtgctgatatctaggaggaggaatattccaggcagacggaagagaggcacaaagtctttgaggaaggggcatgttgggcatgttcacaggacagcgagg

SEQ ID NO: 338883 - DNA, 685 bp, Homo sapiens
ggtcaggacacagagtggcacagataagaaatgaggtcaggacacagagtggcacagactggaaaagaggtcaggacacaagagtggcacagacaggaaatgaggtcagtacacagagtgctcctgacaggaaatgagatcaggacagagagagctccagacaggaaatgcagtccgggcacagtgtgttgcatacaggaaatgaggtcaggacaaagagtggcacagacaggaaatgaggtcaggacagagtgacacagacaggaaatgaggtcactggctccagacaggaaatgaggtcaggacagagagagctccagagaggaaatgcaatccggacacagcatgttccagacaggaaatgaggtcaggacaaagggtggcacaaacaggaaatgaggtcaggatacagagtgctccagacagaaaatgaggtccggacaaagtggcacagacaggaaatgatatcaggatacagcatgttccagacaggaaatgaggtcaggacatagagagatccagacaggaaatgaggtcaggacagagagagctccagacaggaaatgcagttaggacacagcatgttccagacaggaaatgaggtcaggacagagagagctccagagaggaaagcaatccggaccactgcagccagagacacatgcactccagaggaccgagcata

SEQ ID NO: 338884 - DNA, 343 bp, Homo sapiens
ggtcaggacacagagtggcacagataagaaatgaggtcaggacacagagtggcacagactggaaaagaggtcaggacacaagagtggcacagacaggaaatgaggtcagtacacagagtgctcctgacaggaaatgagatcaggacagagagagctccagacaggaaatgcagtccgggcacatgagtggtgttgcccgtgggcctggaaggtccagccgagggttggggcctgcggatgtcgcttctctgaagatgagaagccagggcgaggccccccccccacatctggaaggttctcctgcgtcgccctctccttcccggggggatcctctatgagtcta

SEQ ID NO: 338885 - DNA, 1320 bp, Homo sapiens
ggtcaggacacagagtggcacagataagaaatgaggtcaggacacagagtggcacagactggaaaagaggtcaggacacaagagtggcacagacaggaaatgaggtcagtacacagagtgctcctgacaggaaatgagatcaggacagagagagctccagacaggaaatgcagtccgggcacagtgtgttgcatacaggaaatgaggtcaggacaaagagtggcacagacaggaaatgaggtcaggacagagtgacacagacaggaaatgaggtcactggctccagacaggaaatgaggtcaggacagagagagctccagagaggaaatgcaatccggacacagcatgttccagacaggaaatgaggtcaggacaaagggtggcacaaacaggaaatgaggtcaggatacagagtgctccagacagaaaatgaggtccggacaaagtggcacagacaggaaatgatatcaggatacagcatgttccagacaggaaatgaggtcaggacatagagagatccagacaggaaatgaggtcaggacagagagagctccagacaggaaatgcagttaggacacagcatgttccagacaggaaatgaggtcaggacaaagggtggcacagacagaaaatgaggtcaggacagagtggcacagacaggaaatgaggtcaggacacagagagctccaggcaggaaatgaggtcaggacacagtgtgttccagacaggaaatgaggtcaggacagtgtgctccagacaggaaatgaagtcaggacacagtgttccagataagaaatggggtcagaagacaccactcagtcatattaatcagccaaaggatagatttatcaaaactcaagacgcaaggtgtcagcacgtggggctgtggcaggtacaggtctaagcagctggactgaggtcaagcaccatagtgcttgtcacactcaggtacgtgggggtcactcaggtacatggggtcaacagaagactatgcagcaagaatggggagcgtccctgcctgtggaaagttggggaggacaggatggggacactggctgtcatcattcagcttttggtatgccatggactccttagctaaagataaaagacaaaagaaaggccgcatggtagggtgaccgacacctgagagaaactggcctaacaagcacgtggggtgtggtgccagtccacagcacgcaccacaggacacagaggtgacactgtggggcagtgcccagccatgtcccctaaaagccacctgcacccaagtgcacagcacaggcatttggaggaaagaagtgtatgttgtggctgtctcca

SEQ ID NO: 338886 - DNA, 469 bp, Homo sapiens
cttttgttctgttgctttggttggcgatcgggactcaccatgttagacctgaggttcgtggtgggatccaccggcgtggccctgggtggctgccctgtgtgctcagggagcagtcacgggccctgagtggtgttgcccgtgggcctggaaggtccagccgagggttggggcctgcggatgtcgcttctctgaagatgagaagccagggcgaggccccccccccacatctggaaggttctcctgcgtcgccctctccttccaggcacatttggccgtccccttttctgcgtgtctgtccccaccatcgtgccctcttcttctctggactgcgtttggatgatttctttgaacggtttttattctggaaagttctgctcgagcatctggtatctccctggtgtttgggatgtctccttctcattcccccgtgtcttgctttaagctgcgtgtcctcgtgtttccgctgccc

SEQ ID NO: 338887 - DNA, 188 bp, Homo sapiens
caacacttctttcgctccaaatgcctgtgctgtgcacgtggggtgtggtgccagtccacagcacgcaccacaggacacagaggtgacactgtggggcagtgcccagccatgtcccctaaaagccacctgcacccaagtgcacagcacaggcatttggaggaaagaagtgtatgttgtggctgtctcca

SEQ ID NO: 338888 - DNA, 466 bp, Homo sapiens
attggttggggcaatgattttttggatatgaccccaaaagcataaggaataaaagcgaaaatagagaaatggtattgcatcaactgaataagcttcggcacagcaaaggaaatgatcaacagagtgaacaataattgacagaataggagaaaatatttgcaaaccatacatttaataaaggcttaatatccaaaatatatttaagaactcaatgatacaaaaacaacccaagtttttaagatgaacaaaggacttgcattgatggtcttcaaaagacaacatacagtgtacatcaggtatgtgaaaaaatgctcaacgtcattaatcatcagggaaatgcaaataaaaaccacaatgagatgtcacctcacacctgttagatgtcacctcatacctattatccaaaagacgataataagactgtaagtgttggtggggatatagagagaatagaactcttttacac

SEQ ID NO: 338889 - DNA, 382 bp, Homo sapiens
tatcagtcatacttcaacatgttctattaatcagaagcactgtgtgacttttcactaacatttatttctaaattactaaatattattgtattctacagtctcagagacaacagcatacttagggcaattttctgagttgtttaatgatggtggctaattttagcctccaatagaaatcaaatggtcaagagccaaataaatacaagctgctttaaaatgaacatgcattacagtgagattcaacaggaaactgctgtttataaacaagttatgctttcatataaaactaaactcacaaatacatagacattttcaatgagagatttactgtctccttttaaccttcaaaaatgtgtgtgtgtgtgtgtgtgtgtgtgtgtgt

SEQ ID NO: 338890 - DNA, 304 bp, Homo sapiens
ctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccgtggaa

SEQ ID NO: 338891 - DNA, 334 bp, Homo sapiens
tggtaatatgtggagaggaagttacccaggtctgtgtgtctctttccaatatgatttgacccgtctgctgtccctgtgttctcttgtgaagaaaggggccgcttctccttgatataggcaatagcccactctaggtaggaggtgttcactaatggtgaaagaataaatccgtaactgtggcttctcagctactagaaaggcaggatacagtgtggtgaagtcctgagaatcagctcatctgagtttgcatcagactcctgctttagaagctacttgaccttgggcaagtcatttcaactctcagcccccattttcaggataatggggatgataa

SEQ ID NO: 338892 - DNA, 209 bp, Homo sapiens
tttgtcttgtggtttaaaggccagcttagccacagtaggacagaataccaggtagatttctaagctcaaggacagtatctgtggacccattagggacctgggggaactcactgccctgaagggaaagacacaaacctggctggcttccccacctgctaatagtaggaaccctagggccttgagcgaatttaggcaaatttaggcggtag

SEQ ID NO: 338893 - DNA, 180 bp, Homo sapiens
tcctttcatttacgtagtagcctttgttaccttccttatgtcgggagtgttccctcatccctcttttggcactgcaggaaggacattgacagtgtgaagtctacttcaggccatttctgtcggtctgggcaagtcactcagtccagttttcctatggtgccctgttaggtttaacctttg

SEQ ID NO: 338894 - DNA, 292 bp, Homo sapiens
tggcaataataataattttaggcagcccttactgtgtgtcaatcacggctctatgtattaactcatttaatcctcacagtgaccctgtgagagggctgcaattattatcctcattttacagatgagaaaacagacagcaaggttagaagtttgcccagaggccacagagctaagaagtggcgaatctgggatagaaacccagacagactggctccagagacctgctcttaacgacctgctctgcctcctacccttggtacccatgtgcctttctagggctggctcagccact

SEQ ID NO: 338895 - DNA, 620 bp, Homo sapiens
atctaagcaggttttcactatatttcaacagtacctcccccttccacaacctctaaatccaacctaaagatggtagtcagagtgattctttacaaaatataaatgtaataacattatcgtgctttagaccttctggtggcttccactgtcctcaagataaaagttcaaactattcacttcagttaataaaacctacctcttctctcaacattttctatattttcaccagtctagcccacagcagaagtttatccttctgctcctaaaacacatgaagattacaatcatgccccttgcaatttgctcattttcaggttagtcaactccagtcccttcaaccattactcacttcacatggtctttaggacactctccccttcctttcttggactcctaatttaatgaattctatttgttcttatccctcttaaaatgtggctttagggccgggcgcagtggctcacacctgtaatcccagcattttgggaggccgaggtgggcagatcacgagatcaggagttcaagactggcctgaccagtatgatgaaacctcgtctctacaaaaattcaaaaattagctgggcgtggtggcgcatgcctgcagtcccagctactcagga

SEQ ID NO: 338896 - DNA, 954 bp, Homo sapiens
gggcagaaaagctctgtttgaatcgactcaccgggacaggcagctgaggaaggagcgccatggaagccacagatgggatgactctgctgaagcaggaatgcacccagccgggaggccgccagccctgccagccgtcagcacacaaaggcaccgctgtctgctggggaggtcgggagcaggccctgtgtgcctaaatgtgcctgtggaggcagcgtgggctctccaagatggggcgtgttctgtgtctgcacctgctggtctctctgtgctggctgagctgagcacctactgtgtgtgtgccgggcactctgcagagagtgtacagacagcaggctggggcctgcctggaggaggtgactgtttcgtgctcagagacaggcaaatcagcttcaagatgagagccagagactagcacagaggaggggcgccccaccgagcctcgagagcttctggggtgggtacgggcctttgatagatgacacagcacttctatagggcaccaaaaaggggctgctgggcctgtctcagccttagacttgggaatagtgccacgtattgcctttgagcaagaggaagtgtgtcgtggaggagagactgtgggttttggactagacagagcaggaatctgcctctttagcttcctaactgcaacctggctggagcaagtcaactcactctaattgagcctttgtcctcttgtcctcctcttgggcttcatgacactcctgggcagggccatggtaagaagtaagacgccgtgtgtgtgatgcctgcgataagtacctgttagagctggcagtaggagtccaaacacttcttgactgaactgccccgccttccacggaggcttcaaatcgctcattccttccgtccacactcctgctcgcttaatgaaggtgatggccaaatgcatcttccaggcagccatttgaatctccccaaaaacactctccc

SEQ ID NO: 338897 - DNA, 229 bp, Homo sapiens
cacaatgtggctttgcttctttaagagctcaagttggctgtttggtggagaatggttttggtttgggctcaagggagaagagaatgtaaaagtggagagagagctattaggaggttattgcagtggtccgaaagagtctggtggctttagattacagaaatagtgatacagatggagagaagagatactgatttgacagatatttttgtcttggtgatgtgggggctga

SEQ ID NO: 338898 - DNA, 204 bp, Homo sapiens
ccaaatattctcacaaaggctgttaaaagaaataaaagcttaaggaagcttaaacgctttccctgactctgaatgatgacgcactgaaacaacaggctgtgtgtgtcacagccgtgcctgtgccaacaggaagtttgggctgttaactgggcttccaggtttaggtggtccaagaactgctgagcaaacacacagcctttttct

SEQ ID NO: 338899 - DNA, 3069 bp, Homo sapiens
  misc_feature (3068)..(3068): n is a, c, g, or t
aggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccagcaccaccactgagatccggcttgctacaaaacccgaaaagcgctgagttng

SEQ ID NO: 338900 - DNA, 2088 bp, Homo sapiens
cccatactgttgacattgtattagatataagtgatttagagatgatgctaagtgtacaggagaatgtgcataggtgcatatgcaaacactatgccccccccaccgccccccacctgttttttgagacagagtctcactctgtcacccaggctggagtgcaatggtgtgatctcggctcactgcaaccttcacctccagggttcaagcagttctcctgccttagcctctcaagaagctgggactacaggcgtgtcccactatgcctggctaattttattgtatttttagtagagacagggttttgccgtgttggccaggctggtctcaaactcctgacctcaagtgatctgcctgcctcggcctgccaaagtgctggagattacaggcatgaaccactgcgcctggccctaacactgtgccactttatatcaaggacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggtgagtgccctgcaagtggcaacacgcgccccccattagcctgttctcaacctgggggcgggagcctagctctgactgacagcttccttcaaggcaagtctcttgggggtcgtcaggggtggagccaagcagaaaggtcatttgtgattggcttctctaaagaggagggataggagggctgttctgattggaccgttttgtgtagttggctaaaagactcattcggattggttgggtgactttggcttttttttcctttgacttgggcagcgtgttgtcaccttagcgactccagagaagcctctgttgtttggagggtgtgggtctgtccctggttggccagggattctgggtggggattagccggagaaggtcttttgtttcctcactggtagtggttggccagtctctagttggaactggggcgagtagtgagtgaggtggggcggccccctggcccctgtgggtggcgggggctgtgcagggctctgactgggtgctcccccaggggcagagatgcagccttatgtgcagatggtcctcaacaacctggtggaaatcattaaccgacccaacacacccaagacactgctggaaaacacaggtgggcacctggcccggctgctgcctgcacccctgcctgccttctggaggtggggttctgggctgggaagggcatcagaaagagccttgtcaaggaaccaaggagggtgtctggaagtacctggaaggggtcactgggagaagccccaagaaagatgcagcctcaggctgggtgcagtggctcatgcctgtaatctcagcactttgggaggcagatcacctgaagtcaggagttcgagaccagcctggccaacatggtgaaaccccatctctactaaaaaatacaaaaattagccgggggtaatggcacgtgcctgcaatcccagctactcgggaggctgaggcaggttgcaatgagccaagatcatgccactgcactccagcctgggcaacagagcaagactccatctcaaaaacaaaac

SEQ ID NO: 338901 - DNA, 5060 bp, Homo sapiens
aggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338902 - DNA, 4816 bp, Homo sapiens
aagatgagaaacacttcgatggacctctgcccgagaccaaaaatctcctgcgctgttccaggctcatacaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338903 - DNA, 4668 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctagtcaggcctactcttttttctttaaaaaaaaccagttttactggtttatttattgttgggctgttatcgggcgaatggagatgaaattgtttacgattcttccct

SEQ ID NO: 338904 - DNA, 3707 bp, Homo sapiens
cagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338905 - DNA, 3393 bp, Homo sapiens
cccatactgttgacattgtattagatataagtgatttagagatgatgctaagtgtacaggagaatgtgcataggtgcatatgcaaacactatgccccccccaccgccccccacctgttttttgagacagagtctcactctgtcacccaggctggagtgcaatggtgtgatctcggctcactgcaaccttcacctccagggttcaagcagttctcctgccttagcctctcaagaagctgggactacaggcgtgtcccactatgcctggctaattttattgtatttttagtagagacagggttttgccgtgttggccaggctggtctcaaactcctgacctcaagtgatctgcctgcctcggcctgccaaagtgctggagattacaggcatgaaccactgcgcctggccctaacactgtgccactttatatcaaggacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338906 - DNA, 3503 bp, Homo sapiens
gcctcatcactcgggcaacaggtacctgagtcacagtctgccaccccgacccagggagcgcccatttcgtgctccctctccaggaatacatccagaagctgatgcccccactgatccagaagtggaatgagctcaaggacgaagacaaggacctcttccccctgctggaggtgagtgggctcctgcccctcacccgaaacccatcctgcccaccctgcctgagttctccccacctgccttcctccctgccagtgtctgtcatcggtggccaccgccctgcagagtggcttcctgccttactgtgagcccgtctaccagcgctgtgtcaccctggtgcagaagacactggctcaggccatggtgagcaaccctaggcccgtcacctgtgcttctgcattggcctgcctcgggcctgctccacttacccgtgcccctgtcggcatctgtgtctagatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338907 - DNA, 4951 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgacaacatacaaacatagatatagaagactaagataaaatagcaagagttagctagggtatatagccagagaaaaattgcagaaaagtgcgtgcgaggcagggagaccccctttcccgcgtgatatcttcaggaaggctgcccgagatgctgggcagacacatcgtcaccagtgtgcccgagattgacccggtcttgtgccagggcaagatatggactccccatcctgtgcagtgggctctgtgtggaatgagctgggagctgctgaaggaaggtgggcgtataatggcgcgtgacccaggccagagagatccaggctcagaaagttcttctccagcttcacctgatgaagctgaggcacacctccgctctgaggtggggccagcctaagggccaggcacatcgggcaccttccgtccccatggtactatagcgcgatggccaatagaactttattcctacaccttttcctagggggctggtccggtccgacccctccaagctcagtggacactgggtctgaaaggaaggagtcttttgcttcctttctcctttttacaaaaacaacatagaaga

SEQ ID NO: 338908 - DNA, 4649 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgaccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338909 - DNA, 4286 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttcctgttctactcttgggagcctgtgttgatcggagattcgcactgggcgtcatcaatctctggggcaaacttcatcagcggttacaaagcagcgtaaacaggacagaactcaatggtcctccctaaaagttgcttaaaaaacctcttgccccaaccgga

SEQ ID NO: 338910 - DNA, 1013 bp, Homo sapiens
tactactactaaattcgcggctgcgtcgacccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338911 - DNA, 3522 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgtttgctcccgggtctgtccatttgttactgtgctgtgctggggattggcgccgaggtggcgtgagattccacttgtgtagaactttgttgagtaaagatcagtttcttgtgaactccttagtctgtggcttcctgtgtccttggctttggtagtgaagaaatgt

SEQ ID NO: 338912 - DNA, 2872 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacaggtcgcctgacgagtccctctgccattccagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtaaggagactgcagctggcaagtcagcactgtc

SEQ ID NO: 338913 - DNA, 3545 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggtgagtgccctgcaagtggcaacacgcgccccccattagcctgttctcaacctgggggcgggagcctagctctgactgacagcttccttcaaggcaagtctcttgggggtcgtcaggggtggagccaagcagaaaggtcatttgtgattggcttctctaaagaggagggataggagggctgttctgattggaccgttttgtgtagttggctaaaagactcattcggattggttgggtgactttggcttttttttcctttgacttgggcagcgtgttgtcaccttagcgactccagagaagcctctgttgtttggagggtgtgggtctgtccctggttggccagggattctgggtggggattagccggagaaggtcttttgtttcctcactggtagtggttggccagtctctagttggaactggggcgagtagtgagtgaggtggggcggccccctggcccctgtgggtggcgggggctgtgcagggctctgactgggtgctcccccaggggcagagatgcagccttatgtgcagatggtcctcaacaacctggtggaaatcattaaccgacccaacacacccaagacactgctggaaaacacaggtgggcacctggcccggctgctgcctgcacccctgcctgccttctggaggtggggttctgggctgggaagggcatcagaaagagccttgtcaaggaaccaaggagggtgtctggaagtacctggaaggggtcactgggagaagccccaagaaagatgcagcctcaggctgggtgcagtggctcatgcctgtaatctcagcactttgggaggcagatcacctgaagtcaggagttcgagaccagcctggccaacatggtgaaaccccatctctactaaaaaatacaaaaattagccgggggtaatggcacgtgcctgcaatcccagctactcgggaggctgaggcaggttgcaatgagccaagatcatgccactgcactccagcctgggcaacagagcaagactccatctcaaaaacaaaac

SEQ ID NO: 338914 - DNA, 678 bp, Homo sapiens
ttttttttaacaaatggcttccagagacctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338915 - DNA, 1632 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgagtgtgtgcccctgcctgggggtggtggtggggtgcaagccctggactccctcttgggaggtgactagaagctgaggcagaagctgattagaagctgatcgtggccgggcgcagtggcttacgcctgtaatcccagcactttggaaggctgaggcgggcggatcacgaggtcaggagatcaacaccatcctggctaacacagtgaaaccccgtctctactaaaaatacaaaaaattagtcgggcgtggtgtcgggcgcctgtagtcccagctactcgggaggctgaggcaggaaaacggcatgaacccaggaggcggagcttgcagtgagccgagatagcgccactgcactccggcctgggcggaaaaagtgagactccgtctcaaaaaaac

SEQ ID NO: 338916 - DNA, 875 bp, Homo sapiens
aggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgaggctcccgggtctgtccatttgttactgtgctgtgctggggattggcgccgaggtggcgtgagattccacttgtgtagaactttgttgagtaaagatcagtttcttgtga

SEQ ID NO: 338917 - DNA, 294 bp, Homo sapiens
gtgctctgtgtcattgtgggcttattagggagcgggatcccccaggagctggcagcctggtcccagtggtcagagatagtgtcaggtacataatgaggggacctggctgggggaaggcctctgtcttccaagtcccttaacagcctggcagaaactcaaacaactcaatcagtttcctgacttcaacaactacctgattttcgtcctgaccagactcaagtcagaaggtacgccctctgctcccttccatgcgatcgggaccctgctttctccccctgggcccctgaacctcag

SEQ ID NO: 338918 - DNA, 296 bp, Homo sapiens
ggactcagccttccgcggcatctgcatgatgatcggtgtcaacccggggggcgttgtgcaggttggggcagctgggctctgagggcaggcgcgggcgctgggctcgggcggcccctcacctgggatccgtcacgtttcaggactttattttcttctgcgatgctgtagcctcctgggtgagcccgaaggatgaccttcgggacatgttttataaggtgaggctctgtctgggccctgatctagttccgggagcaggcaggggtgagaccatctggtaacaatggggcctggggatg

SEQ ID NO: 338919 - DNA, 4850 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338920 - DNA, 4880 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacaggtcgcctgacgagtccctctgccattccagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338921 - DNA, 4902 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactccttagtctgtggcttcctgtgtccttggctttggtagtgaagaaatgt

SEQ ID NO: 338922 - DNA, 3140 bp, Homo sapiens
caggtcggttaatgatttccaccaggttgttgaggaccatctgcacataaggctgcatctctgcccccatctggagtgtctgtcatcggtggccaccgccctgcagagtggcttcctgccttactgtgagcccgtctaccagcgctgtgtcaccctggtgcagaagacactggctcaggccatggtgagcaaccctaggcccgtcacctgtgcttctgcattggcctgcctcgggcctgctccacttacccgtgcccctgtcggcatctgtgtctagatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338923 - DNA, 3152 bp, Homo sapiens
caatccgctcgcctggtggtaagcttagccgcgctcggtgaggatcctcatgaggtagtcagtcaggtcccgccagccaggtccagacgcaggatgcatggggaggcatacccctcgtagatggcacagtgtggtgacccgtcaccggagtccatcacgatgccagtggtacggcagaggcgtacagggatagacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338924 - DNA, 4802 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaacatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtga

SEQ ID NO: 338925 - DNA, 3201 bp, Homo sapiens
cgtgagtcgtcatgattgatcttagtcaaaccctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggaggaatgtgacctttagagtggccctgttattactcccatgctttggaccagat

SEQ ID NO: 338926 - DNA, 1423 bp, Homo sapiens
aggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaaggtacgccctctgctcccttccatgcgatcgggaccctgctttctccccctgggcccctgaacctcagccttcctcctcccagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggtgagaggggcagcgggggttggcctctgaggacacactgaactctcacttctcagcatgttaagtgtagtgcttcatggaatgctctggcaccctctatggtagtactattactattgccatttgatagatgaggaagctgaggcgctgagctattaagggacctgtctgggtaagcagcagaagtcagaaacagctgaggcagtgcagggccacgctctggaaccactccctcctgaaacagtccttcttggctctgagacagtcatgcaacatctagaattttgtgttcggccttgggctgagtgctaagggtatagcagttaaaataatgcaggtattcatgtttcaggtgcaacggaattaggttttcagcagagccttttctgactcttggaaggtggcctgaggaagttacagaaagatgactaagaataggctcacgcctgtaatcccagcaactttgggaggtcagggtaggcaaatcaccagaggttgagttcaataccagcctggccaacatggtgaaaccccgtctctacttaaaatacaaaaaacttagctggccaggcatggtggctcacacctgtaatcccagcattttgggaggctgaggtgggcggatcacaaggtcaggaaatcaagaccatcctggccaatgtggtgaaaccccatctctact

SEQ ID NO: 338927 - DNA, 175 bp, Homo sapiens
agccatggatggccagagcgagtactggggggctgggaccaccacccaccacccacgtttgtctctctgcccctctgcactcagggagcctttggagccctgcagaagatctgtgaagactcatcagagcttctggacagtgacgccctcaacaggcccctcaacatcatgatcc

SEQ ID NO: 338928 - DNA, 703 bp, Homo sapiens
gagaagagtcatgggaccatatagggtaaggtgggggcccctctgtgacaccctcataaaccggagctctgcacagtgatgtggacaaaagggaaagttggagagctttgtggagacacacagcagggattggttctggctcatctctctgaattgcgtctttgaaatggactagtgcacaccctgaagggctgttagggttaagtgaaatgacgctggtgctcaataaaccatagcagttgtacttgttttcattgacccctcctctgcctcactccagccttctcactccagctttgcagcttatttcctgttgtctcttgcagctgtcctttcatttcccttcccaacccttttttacatagaacctaggccacagcagtagccttgtagctttttcttggtgtttccactctaaaccacacatgattttcccttaattttcaactcggctctggtgtttcaaaaccttcaagtttccagtgcacacccaattaagtccaatctattctgggacagctatcaacaccctctgagtgtgctcccagcctttcactctctctaatcttaactttcattatttgcctctgaaacccacattccagtcggcaggctagtctgctggccggttccattacgaatccacactttggatgctctttcctgggtttggaatgccttcaaaaatccatctttcaaaatc

SEQ ID NO: 338929 - DNA, 2252 bp, Homo sapiens
gtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaa

SEQ ID NO: 338930 - DNA, 2572 bp, Homo sapiens
gtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaaaaaaaaaaaaaaaaaaaaaaaaaaaaaaggggggggggggaaagagaccccctcgggggccccagattgaccgggaacacacaactttcgtatttacaacggggcgccccataaaggggggccgaaaataaagcacaagacggggggccgagattaaaaagggcgcgcggggggaaacagcgcccgcgtgcaccgtggggaggaaccaacctgggggggcggcctatgtggcacccccaacgagatatagtctggggaaacaaattcggctatagtgtacaaccgcatgctggggcgaaatgcacggaatcttgaaattg

SEQ ID NO: 338931 - DNA, 460 bp, Homo sapiens
tcttggcctttcccctgaggaggctggggggcttcctttattagccctgcctggctagggtagggggtcaggattatagaatttgcctcttttcctctccttcaggacttggcttggctgtggtatctttgggctgaggacttcctcgtcctcagggcaggccatggttccacctttatatccccaagatgtcctctcttttttttctttttttctttttttgagacagtcttgctctgtgcccaggctggggtgcagtagtgtgatcacagctcactgcagcctcgaactcctggactcaagccaccctcccaccccagcctcacaagtagctgggaccgcagacaagggccactacacctggttaattttttattgtttgtagagatggggtcttgctatgttgcccaggctggtttcgaactcctgggcatgaggagtcctcccaccttggcctctc

SEQ ID NO: 338932 - DNA, 203 bp, Homo sapiens
ttcttgtttatgtgtttagggaattaaccgcaagcctccatttcccatgagtaaatatcaggtggtaacacccaaggctgaagtaagggttaaactggtttatgcctgggaaagggcctgagtccaagcagagtggatgctcagtggaagtctccctccttcatctcctcctttccttcctcttttctatcctcagccacttg

SEQ ID NO: 338933 - DNA, 736 bp, Homo sapiens
acaaaaacaagttgaagataacaaagtgggagctttaaaaatgcagactgaagttgcagctgtacaaacaaatgaaaatgcccaggattcattcagttgcaagtgtgagaaagagatgacattggataaatagaaagaaatgtaatgattcacttgtctataagaagaagcctggacttggcctcagccgtgagcggctctgaggaacctcccacaaggtgagtgtattgaagtctgagtccacaccttgctttcggctcatgtccgctctctgtatctgtctttgctcagcttttgtgtgttggcctcactgacttcctcttttggaggagacaggatgaccagcagctctcatctccatgatttgcaatccagaaatattgattacttgcttgcttggcttgggtgctgtaccaaatgtaccaaatgctataccaaatcttgtaccaaatgctgcatctgtggtagatagcctccaaaactgagtactgacacttcaacgtccctttatatgtgaaagcttcttctcctatctgcagattaatctatttctcctctccttggatcttggccagtttagtgacttgcctataggaggtggtagatgtgatgttgtgtcagttacagaactagtcattaagagacctgggagctttcaattagttctcagatctgactgtcatgctgcagagaagcccaggtgattctacagaagagggaggcttatggctatatt

SEQ ID NO: 338934 - DNA, 518 bp, Homo sapiens
ctgaatctgtgacttggtctctgtttggcagcctgagattgtgactcaggctctctatggcaaacagaaacctaggctgttactggggtcacagtccccactatagtgaactggagctgtgactcaagctctgtatgtgaactgtgtctgactcaggccctgtatggtgaactgaggctgtgactcaggctctgtatgtgaactgggggtgtgatctggggtctgcttggtaacctgaggctgtggctggggtcacagtttctgctatggtgaacaggggatgtgactcaggctctgtatggtgaactggggctgtgactcaggatctgtatggcaaactgagctgtgactcaggctctgtatggtgaactggggctgtgactcagactctgtggtgaactgaggctgtgactcaggctctgtatagtgaactggggctgtgactcaggctctatgtggtgaactggggctgtgactcaggctgtctatagtgacctgagtctgtgactcaggctgtc

SEQ ID NO: 338935 - DNA, 203 bp, Homo sapiens
atccaaatgacttcattttaacctgtttacctctgtaaataacctatctccaatctcattttgaggtactggagtttaagactccaacatatggagttgtgttggaggggacacagctcaacccataacactcactcaactacttgttctgtctttttgaaagaaaacttctttttttattatttttttaattttaagacagc

SEQ ID NO: 338936 - DNA, 618 bp, Homo sapiens
gctttcccttggtccctacaaaactcacttccaaaatctccctcgaataccatcctccctcaatggtaattctttgccaattaccatcacctgaattcaggtccgcctattgcttggcctcccattgatctcctatccaaattgctacaaagatcatctttctagattctagagctggttgtgtcacaccttcatcagcacctcactgcctcactgcccagggatgtttattgcaagtacagattcccaaacccaaatccataaccagagaatgggaatttctagggcaagctgagaagtggtatatgtactttcaagtggctcggtaattggctccacctgcctccccaggcacatctcgagccagtcctctcctagtaccctgtggtccctttacagagaataccctgcccctgaacaaacagatccagatttggacatatcctttcccatctgcctggaattcccttttcctgtggcacaagtccaccattcttcaaggcccagctccaatgccacctcctctgggaagccttctcccgtcgcctaactcagtggctttcaaacatctttgcttgagactcaatcccaagaaacacatttcacattgtaattcag

SEQ ID NO: 338937 - DNA, 510 bp, Homo sapiens
gttttcccattacctttaaatgagagagtcagacaactaacctgccaagtctaataatagcatgataagtgttctgttaggggaagttttaagtgggaacacagaggaggtggtatgcagaaaggcttttgaataattaggaaaagccttcccagacctctaagctgaggtctgaagagtaagtaggagttagctcagtgaagaattgtaaatctgtgtttctggcagaagaatatagcttgtgcaaagtccttgagacaggagatagaagacgctgccatgggatgtgaaagaagttcatgtgaccatagtgcaagatgggaagtattagagttgtggcaaaagtatgcaggggctagatcttcaagacatgtgaattattattaagaaatttgggtttaatcctgaggactcccctcagttcttttaattggacattaacctgattagatttgaatgtttgaaagatcactctaattacaacatagtgattaggttaagaacaggatg

SEQ ID NO: 338938 - DNA, 475 bp, Homo sapiens
aaagcctgtcctaattatctccaactaattctaatcattctatcccatttaccctttttgtcatttctttatattatatataaatatatgatatatattttttcattttaattaatgtatttgaattcaacagatgatattaatgtcattgcttatttcactcatttttctaactttttttcactgatgagttttctgcactagcttataaacttaaaggcaagaaccatgctttcttctttctttacatgactccatggtcccagaacacccagtgagactggaaaagaatgaaatgatggctatatgtgtagtatgtagtttgattccatacgtgaagtagacacccagaaaagatttgtagttaatgaatttatctttgacctctgaagaaactatgatatgataatagatgtcctcagctattttttgttaccttggtatgattaactgccaacattctttaatccacaca

SEQ ID NO: 338939 - DNA, 258 bp, Homo sapiens
acctatggaaagctgacaagaaccaactcaatcctgaaggaggaaataagtttcccaataaaagaacctaatgaagacagatccactcaagaaaaaaggagatgatggttgaagttacagggatgatgctgtcactggcctagcagtcatcacttcatagagagcttatgcaaacaacagcttcctcattgtccttcagaagaatgggccgttcccttccctccactcaaacttcctgtgctgccaagccacattcat

SEQ ID NO: 338940 - DNA, 331 bp, Homo sapiens
gcggagcttgtaatgagccgggatggtgccgctgcactccagcctgggcaacagaatgcgactccatctccaaaaaaaaaaaaaaaattgcctttcctgtatagttactcatttatttctctctgttttctcttttaaaataaccaaatttctctgctataaataggatgggatcaactcatgtagtaaatgggaggtttttgaggaaaaaaaatgcaagactttaaaaatcattgataagtttattaaagcctttctcagcgattacctaaaataagaacttttgaaaaatactgttaatacagctttttttttttttttttgggagaca

SEQ ID NO: 338941 - DNA, 340 bp, Homo sapiens
tgagggagtgagtgagtgaggaagagaggcaggcagggaccgggtgacacggcctggtccacggtgaggagcacaaggctactctgcatctatactccgggaggggagacacaggagggctcagaatgggggtggtgtagaccaaggtacactctgaacagatcctctggcagctgtgtggggagcagatgaatgaagggtgcaagtggaggcagggaaaccagttaggaggctgtcacccagacaagagatgatgctagcttggccccaggtgacagaggggaggaggtaagaaatggttgagcaccctaccccgagcccagctcccacacagatgcac

SEQ ID NO: 338942 - DNA, 320 bp, Homo sapiens
cagcacctcccagaggaccccctgtccagggaggctgcttgaaaacattagcaccaggctagatccctgaataggcacagcttcagtgagcagggagtaggctaggcccagagcctcattctttgctcgattcaggagccttgggaggctggtggaggggtgaactgaggtgcctgctgtgtaaccagggctagggctgtctctcagggagttcatagcaggacactcctttgcttactgtcgaggtttgctctctggtgacttccaaattaggaatccaagctagcctggaaacccaggaatgcaggaggagaaaaagg

SEQ ID NO: 338943 - DNA, 408 bp, Homo sapiens
ctcaagaactcttcttctgtgttctgttctcatctctaactgccatgtctgcttacccctacaatcatgaacacaagggtagctcttattctggctactaacctcataaattagttttgcgtatatttggaattttataaaggaataatatagctgcttttgtccaacgttatgtgtgagtcttccttggtgttgaattagttgcagtttgttcattctcattactgcatagcagggttcggcaagtcacagccagtgggccagatgcagcccgctgcctgttttgtagagaaatctttgctggcacacagccactcctacttgttgatatattgccggtggctcctttcaggctaccacacagggttgaacagttttgacagagaccctacgatcctcaaaacctaa

SEQ ID NO: 338944 - DNA, 498 bp, Homo sapiens
tgatatgctgtctccactaataataccaaaattagcccggtgtggtggtgcatgcctgtaatcccagcacttagggaggcctaggagagtggatcacttgagcacagaagttcgagattagcctgggcaacttgggaaaaccccgtctctaccaaaaatacaaaaattagccaggtgtgatgggacgcgcctgtagtcccagccacttgtaaggctgaggtgggaggattgcttgagccctggaggtctagggtgatcacaccactgcactccaacctgggtgacagagcgaggctccatctcaaaaaaacaaaaaagatttttctaatgtcattccacaaggatagcttatactgctattttggctgtgcctatctcagagccagaatgggcggaagtccttttttcccttttttttttttttaatgagactcttctgcctgtattgatttttagttaagtatgtcatttctacttttcatgcctgtatttcagaag

SEQ ID NO: 338945 - DNA, 569 bp, Homo sapiens
agtcctgctcttgttgcccaggctggagtgcaatggtgcaatctcggctcactgcaatctcagcctcctgggttcaagcgatgctcttgcctcagcctcccaagtagctggtattacaggtgcccaccaacacgcccgcacttagggaggcctaggagagtggatcacttgagcacagaagttcgagattagcctgggcaacttgggaaaaccccgtctctaccaaaaatacaaaaattagccaggtgtgatgggacgcgcctgtagtcccagccacttgtaaggctgaggtgggaggattgcttgagccctggaggtctagggtgatcacaccactgcactccaacctgggtgacagagcgaggctccatctcaaaaaaacaaaaaagatttttctaatgtcattccacaaggatagcttatactgctattttggctgtgcctatctcagagccagaatgggcggaagtccttttttcccttttttttttttttaatgagactcttctgcctgtattgatttttagttaagtatgtcatttctacttttcatgcctgtatttcagaag

SEQ ID NO: 338946 - DNA, 328 bp, Homo sapiens
atgactacgggggaagccgcccccataatccaatcacttcccatcaggttcctcccttttgtgtgttggtatgggcagttgtgtacattgatttgtctagtataaaatgtgtattacatgattgttcagcctatattatgtatagttcaaagaactgctaaactgattttactgttacttggaaaagtttgcaggggtgtagtgaagagtgagttttgacttactttgcacactattaaggtggggaaggaatcatgttattgtacaaaaatgaaggcaatctttcccttctttaaaccttagtcctgatgtttttttaagacaacat

SEQ ID NO: 338947 - DNA, 231 bp, Homo sapiens
cttacaaggataaaacataataaattcaagatcattctcatttctgaatgtcagtgcaaaatcctaagtaaaatagtaacaaacagaaccttactgcttgttaaaaggctaatataccatgaccaagtgaggtttgttttgggaaagtaaggaggttcaaattttaggtaactatttaattctacgtatcagtagatcaaaagaaaaaaaattatatgatctctcatcgat

SEQ ID NO: 338948 - DNA, 373 bp, Homo sapiens
ggacatgtgatccagggtgaacctactagtgagtgtctatcaaacactgtactgctaaacccagaaactagggctagacagctgtggaatgtacatatatttaagtagggctggtgggcattttaggctgtgtgcaagcagaggaggctactacagatccgctgctttatcagcgattactgtcagtacaatacaggcccaggagctgaccagcacacacatgcagcagcccacccacacaggcacaaatccttcttaaaaagcaggcaatggggagaggttgtaaatattaaactgtaatacccttgtccctgttatgcttccaatattctccctttttgccttgagctagtgaaagtgggtttctcctctt

SEQ ID NO: 338949 - DNA, 639 bp, Homo sapiens
ctggagtgttggttctgcaccctccttgttagctggcatttggcagtggcagtagttaggtcacccttcataagaaggagcccatgctgttgggcctatgtagagccttcctctctgtcactccacaggctccattgacgggcctggtactccagccttgggaagaagctggctgacagcactgacaagccatcctgtctgtccttggggtgtagttgaatgcctcttctgtgggaggtgccttgtgttgggcattcacataagataaagattggcactttgtgttccctgccttagggccgtcagcgtgcctcttctccaggcttctggtctcttatttcctttttggacccttttaatacaaaaattagccgggcatggtggtacatgcctgtaatcctagctactcgggaggctgaggcaggagaatggcatgaaccctggaggtggaggttgcagtgagccaagattgcgccactgcacttcagcctgggcgacgaagcaagactctgtcccccgccgcccacacacacacaaaaaaaattaaccacacacccacttgcttctgtagagaaacctagaactcctggtctcagaaatgtcatccaggtctcgctttcaggctttttgattattctg

SEQ ID NO: 338950 - DNA, 663 bp, Homo sapiens
acttaattttattcttttcactcagggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaaggtctgtgttgcactccctaaggaatttatccctctgagtgtcagaaattagctaatggaatgcacgtgctgtgtataaagagatttaagtgattacagtgtagaaatatctttctgtatgtgatacagtggtttctctttcaggtatcattagaaaacattaggcattcaatacc

SEQ ID NO: 338951 - DNA, 6640 bp, Homo sapiens
gcggccgcggggaccctcggcgtggtcctctgaccctgcaaacccgcgacggaggaaggggaggtcctgcccgaggcgccagcccgaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggcgagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338952 - DNA, 6805 bp, Homo sapiens
gcggccgcggggaccctcggcgtggtcctctgaccctgcaaacccgcgacggaggaaggggaggtcctgcccgaggcgccagcccgaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggcgagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338953 - DNA, 4890 bp, Homo sapiens
gtacagtagctctagcgtttcatcacaaagtgtcaggggagagaatagctttcacttttttgtcatccctctcactttctggcctgtctttacggatgctgtcttacagctgcttatccaaagataagtgggttgtggtgatactgattacagctgcttatcagaagataatgggttgtagtgatactgattagcctacggcataaattaagtaaaagggggaggaaaaacagttttgtcatgactcaggaggaagatgaggcacactgtcacttttgagctctgtgttttggcaggtctgccatgacccacgtgggaaataaagggctcccttccgcttgtgtttcaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338954 - DNA, 3991 bp, Homo sapiens
tgccacttcctagccatgtgaacttggggcaattacttcatctctttctgcctcagctttctgtctataaagtggacctaatagtaattgcctaccttatagttgagttgttttctgagtgcatgtgcttagtagctaggcaccctcaataaatgttttattaatgctcagtcagcaacgggtgatgttattgttaatattgtcattatcgagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338955 - DNA, 4474 bp, Homo sapiens
gcggccgcggggaccctcggcgtggtcctctgaccctgcaaacccgcgacggaggaaggggaggtcctgcccgaggcgccagcccgaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggcgagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggttttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgtagagcattgaactttctacatctgcatggtgatacacttacttaacatattcctgtataatcatgtttggtgtatacattga

SEQ ID NO: 338956 - DNA, 328 bp, Homo sapiens
tttatagacctgagttttgtttcttcctgtaggttgatgaggtaatgctgactctgaaacaggccttcagtacggcggctgccctgcagagtgccaagacgcagattaaactgtgtgaggcctgcccgatgcactctttgcataagctctgtgaaaggattgaaggtacagtttaatgtggctttggcaaaagagaagtttgctttggcatttgggaaatgagaaagtccctattgtcattgaatagttctttgtttcgatgtgaaacaagaacccaaagaatcatttctcatgtccactcaaatgtgagtgggctgtcaatctctgc

SEQ ID NO: 338957 - DNA, 6883 bp, Homo sapiens
gcggccgcggggaccctcggcgtggtcctctgaccctgcaaacccgcgacggaggaaggggaggtcctgcccgaggcgccagcccgaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggcgagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagacaagacactgcttcagaatcaagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338958 - DNA, 6367 bp, Homo sapiens
  misc_feature (6334)..(6334): n is a, c, g, or t
gcggccgcggggaccctcggcgtggtcctctgaccctgcaaacccgcgacggaggaaggggaggtcctgcccgaggcgccagcccgaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggcgagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagacaagacactgcttcagaatcaagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgggcgccccggtatgcctcaaggtaccattcattttttccccaggttaagtgaagtgtngagtcccttgcgcaaataaatattttgtccccc

SEQ ID NO: 338959 - DNA, 5990 bp, Homo sapiens
ataggatttttccagcagctgttgattcagttgaagtaaagaggaacagatagctatgaaagtctcaaagttacgtgagcatgttaactcgggttctgctccagctgtcttcatttcaggaccagctgctatcatggaattgttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggcgagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338960 - DNA, 4402 bp, Homo sapiens
cagagctgcttttgccatatctcagcaaccaactactttttcaagatgtcgatttttagtacaagataaagggtcaatggtttgttattgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttatattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgtatactgttacttttcgggagagaagcagctcttggttagagtcttttactgcaggggtccctgggtacctgtctgtggcctgttatgaaccaggctgcacagcagtggtgggcatgcgagcaagcatgactgcctgagctctgactcctgtcagatcagccacggcattagattctcataggagcgcaaaccctattgtgaactgtgcatgcaggagatctatgttttgtgttccttaagagaatcgaatgcctgatgatctgtcactgtctcccatcatccccagatgggatcgtctagttgcaggaaaacagtcagggttcccactaattctacattatggtgagtatataataataatatggtgaggatataataataataatagaaataaagtgcacaataaatgtgcttgaatcattgaatcatcctgaaaccatcccctgccaccagtctgtggaaagattgtcttccatgaaaccagtccctggtgtcaagaaggttgaaga

SEQ ID NO: 338961 - DNA, 492 bp, Homo sapiens
gactgagccccctaccctaagattgcgtcattgttccctaaatatctgtgtctatattttcattaagattaaaaaaaatggcagtagtagtgataagatctcatctagacagtattttctcaggggcagtagggtggaaaagagacttgtgtcaaaatggcctggagaacttatttaaaatatagtctttcagacctcatttcatgtgttaaaagtatctgatgatgaggtccaggagtctgcatttttaataaactgctagttatatgttatgccaagtatgagaaccctggtttaaggtctttagaagtattatcaacatagatttctttgaaaaacctaagatgcctgtagaagaaagacgaacaagaaaatgtattggcacttcaggtcgttgagcttttttttctttttaaatttttctttgaagtgatttccatgtcttcatttagtgaaggattctaattacaaagactttctcattttgtaccc

SEQ ID NO: 338962 - DNA, 400 bp, Homo sapiens
gttcacgccattctcctgcctcagattcccgagtagctgggactacaggcacccaccaccacgcccggctaattttttgtatttttagtagagatggggtttcaccgtgttagccaggatggtctcgatctcctgacctcgtgatccgcccgcctcggcctcccaaagtgctgggattacaggcgtgagccactgagctgggcctctaagctacttctttaagcttttctcgttttccctgagtatctcccatgaatacattttatacatgttaataaagttctgtttgtttttccttgttaatctgtctcctgttaccaaggtcccagctaagaactcagaaaggtagagggaaaattgttttttccttccttacactgggaaaccaagtcaagccagt

SEQ ID NO: 338963 - DNA, 173 bp, Homo sapiens
ggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatgtgagtctggcacatg

SEQ ID NO: 338964 - DNA, 306 bp, Homo sapiens
atcagaatctacatcccacaggaagccagtaccttccccaccagccacccaaaccgtttctccatgatcactctcagaggaagtcctacatctcaggcacacaagatcagtcagtctacccaggaaggggtgggccacgctcacagacaagcactgccccacaggggccttcaggggctcctgccatattcctgatcacggcagagggtgtctcagggggtgctggtctacccttcacactgctctccacttgcttatcttcctaacagaaagaacaggactatagctcaaatagcctctgactgg

SEQ ID NO: 338965 - DNA, 261 bp, Homo sapiens
tgaagcctgggagaaccgtgagacgaccggagcccattgccccatccaggatgctatttccttcaggtctgaggacaaacatagctcagactctgctatttaagagaggaagaagtaaatcaggttttcttctagcaactactctggattcagcacatgttaggctctgattctgcaaagatacctcgaaattgggcagagccattcctaggtagagaaccacttacagctgttttgtacagaggctgcagttccctatcc

SEQ ID NO: 338966 - DNA, 566 bp, Homo sapiens
gtgtccttatagtagaatgatttataatcctttgggtatataccaagtaatgggattgctgggtcaaatggtatttctgctttacatattttaacttactcgatgatatgtatatgatcaacactcaaatgggcccatgatgagatgcttagggggcattcatgaccaactcaggttgccaggcctctccactgggatttctgattgagtagctctaggtggggacccaggaatctgtgtttttcacaagtactcaggtaacccttatatacaggtgggtttgagaaacactgagtcatgatttctctgttcttgtttatgtttgctgagcaggtacagtgacatttgtgtctgtttgcatgcatgtggccattcgcttgaatttcgccttttctagcccgagtctccttacctgtacaatgggaattgtaataggatctacttcctgccatgtgtgaacattcagtgagatgaagtactcagagcatggtgtctgggatgtggtaagtggtcagtgttaccattgttattggttatggctgttatttagggacacgcaaagtata

SEQ ID NO: 338967 - DNA, 1017 bp, Homo sapiens
ggcgcctgtgcacacagacaacaatgggtcacagttacagaacctgggctcaggtgtgccctctctcgtttctcagctgggggccaacacatttgtaactgtgtttccatgaaaaaacgcatcctaggttccaaacaactaatatactgatgaacctttagaatgaactggacatttttccttgagagaacagctttgaaatgaggaccctgtggtccaacccttctcaatcatggctcccccaaaataactccaatgtgaactgttcaggggtagggggagggggagagcaacagaataacctaatcttaagaattcctctctaatccccagctcagaaagcgtcttttacagtcatcccctctgcagtgtcccagactaagcaaacaaacaaaaaaacatagagccatccccaaagaccaatatgcttgcaatccaagatgggcaagcgacccatctccagtccacatttcagggagacaacagaaaatttttctgattcttcacaaatgggaagaatcaaaagtgaactgttaccagaagcagaaggctgactgcacagccactgtgatgagtttccaagccttgcacaaatacgccgagaacgctgtggctgtacgaactgccttcaatcagacccgacctggccatgtgttatcaaggtcactccttcaggtatgactactccaagcctcaaatctctgtaaaacccaaggagatccacaagatcatctgctccagcgactcccttccccatttcacagattcctcagagaggggcagggatcaacgctaggcatttagttggagggctggatccagcccccaaatctttatccttggctaggaaaacctctgctacccatttcctcatgaccagaggaggcaggagggcagtgtgaaggaattggcttttgccctgctctgcctgtcctggcttcaagaggctggtgccgtccaaaccgctccgttatccaggctttttgaccacgctatgctccaaccccgacacggata

SEQ ID NO: 338968 - DNA, 291 bp, Homo sapiens
ggacacaaatgagttgtagatttggtctttttacataatcccgtatttctcaaagattttcttcattcctttttctttttttttttattcttgtctgactgtcttatttcagaaagccagtctttaagcgctgagatattttcctctgcttagcctattctactgttaatacttgcgattgcattatgaaattcctgtagtatgtttttcagcaatatcaggttgggttatgttcttttctatactggctattttgtctgtcagctcctgtattattttattgtgagtctt

SEQ ID NO: 338969 - DNA, 377 bp, Homo sapiens
cggagggagctggagccagagccagatctcaggaaactggggtcattgcatagaggctgccagacagtctgcagagctcagcggcctgggttcaaaccttctcgcacactgccactgtcggttactttggctttctagagccagattccttggccatgaaatgggtactgcttacttcccaggttattttgagaatgaagtgagatgaagtcaacagtagatgtatctgtccgttgtccctgccctgctgtgggatgacagagtgattttggacaagaccaaggcctcgctgggcatcactgtcttcttcagaaagcaatggggctaggccaggtgcacagtggctcacgcctctaatccctgcactttgggaggcc

SEQ ID NO: 338970 - DNA, 233 bp, Homo sapiens
catttgaccctcgtgacatctgttctttcttcttcttccttctcaaaaatatttcttggattccttgacgacattttctcctgttgtctttctctctctctgcattcattatcttactttatttctgccgatcttaaacgagggtgatatccacatcctttcctatctgctactgcttactccacattctctccatggttcatcacattccctccatggttcatcacattcct

SEQ ID NO: 338971 - DNA, 348 bp, Homo sapiens
caaacatcctattaaacaaaagcactcaccaatggactcaaaatgtaaaatctaacctgtggtatatctgggagatatcacatccttctcatggctatgtgaaggctagatttgaaagagtaagtatgcaaatagaagaccagtcaaaaagataccagtttttcacaagaaaggcaatggagtcctgacctgagatagagagtacattcaaagaatttgttattactgagtatggtatggagagagagggagagtgactcttaggtttcttacgggtgcaccatcaactgaggcagatcataccaggggaatattgatgcaggattttttgctgcttagttcgctgaa

SEQ ID NO: 338972 - DNA, 181 bp, Homo sapiens
taaaaatatgactgagtatatgtatatattccccccacattccaaagataaacactgttaagcatgtaaagcacattttactgtatatatatgggtggcatatgtgtgtgagtgtgtgtgtgtatacatatatacacatacacttctagacatttatatacatgtgttgtgtgtatatgtt

SEQ ID NO: 338973 - DNA, 603 bp, Homo sapiens
gagctcgccggtaaagagggtaaagttgaagatacaggagaaggaaataaaccatcaagagcataaggttaacagcatctgacaaagtccaagaggaggagatccaggggtcagataagtggataaacgtaaacagagatacattctgattacttcagacagatacataacatgggcatgctaggtctgctagttaattctaattgtagaaataaatagttacaggtagttttccctttattgtttcccaaatcaaacttataggtaaatagattttaaaatagaagctttggtgattgaggccaagtggggcagttaaaatttggtcgaaaacccagtcttactgtcttgaagaactagacgacatatcctgggacaaccatagcagttggaaagtgaggctgtggggaaaataccagaaagggagagtcacgaaaacagagccaacagtttgtatacaaactctgtccaaatccttcattgacttctgaagtccacaagtactcatgctccaaagagctgaattatggacaaaataattgaacaggtatttcagttgcagggagggtttggagtctgaggtgagccaagttaactgcttgc

SEQ ID NO: 338974 - DNA, 583 bp, Homo sapiens
  misc_feature (550)..(550): n is a, c, g, or t
ggacactccccgaccctcgccactgaggcaagagggaatatgagttcaggggaaggcattttggaaaactgatctgacttttggtttggtgccaaaaagggtttatgagccattatgggcacaggcttgaaagcttcaaatagctgcgagttagcaaaggtcatggccttggcttctaggaaaatcgtggagccctggaacaggaaatccagggatggtgtcaccttgaagtgtacctgacaataatttttgagttgaaatacaggggcttgagatattcatcataattacatggctcagtaatacaaaccatctcctgatttggaatttgcagatgtctgttttataaaatcaaagtcactgattaatctagaattggcattgcgtcttacaatcacagtagcattttgaattgggcatatgccaatgcattaataaataagtaaaaggtagaattaatagcatcaaactgccgggtgcagtggctcatgcctgtaatcccagcactttgtgagcccaaaagcttaggggaagctgggaacaggagttnttcttttttcttttttttcctttgagacagtct

SEQ ID NO: 338975 - DNA, 242 bp, Homo sapiens
tataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccag

SEQ ID NO: 338976 - DNA, 583 bp, Homo sapiens
  misc_feature (19)..(20): n is a, c, g, or t
gtcatcagctcggtaccanntcgacggagactctccttcccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagag

SEQ ID NO: 338977 - DNA, 133 bp, Homo sapiens
ggggtagatgtaaaagtttacttaggcatggaagacattagaccttttaaaagcaaagtgggctatttcaatctaagaagttagttaatgtaccttagctttctgaagctaggggaaggagaggtgtcttttt

SEQ ID NO: 338978 - DNA, 181 bp, Homo sapiens
agatgcgtttcaccatgttgtccaggctggtctcaattcctgggctagagtaatttgcccatcttggactcccaaagtgctgggattacaggcatgagccactgcacccagcctgaattcttagcaataatctttgaaatctgcaaatagacatgacttacttggcatcatcaaacaagat

SEQ ID NO: 338979 - DNA, 191 bp, Homo sapiens
tcttgtgtcaattttagaaatttgtattttttctagaaaaatcagccatttaaaaatttttaaatctttttaaaatttatgtttgtctattatttctagtattgattatgtttaatgacactcaaagttctttttctatatatttttttaaattgaagaaccaccttgtaatttttttatccaatctgcta

SEQ ID NO: 338980 - DNA, 348 bp, Homo sapiens
aggtttgctgcttaagcgtggcgctcagatcggggaccgggtggagggagttggtgggggctttcctttgatttttcaaaaacccttggacagaattccttctttttcggtaacctttccccgcgtgttaactccgcccctcggttgttcgggaagttctcccacacacctagccttccttactgcagttccaacccctgcacagagttcagccgcggttgtttcttggtggaggttggcaaggagctcttaaaaccatagcccttttctggccgcatttgaagtcatctgaaaagaggctttgtgaagctggatctgcttagtgaagtcaacttggcccccttttcc

SEQ ID NO: 338981 - DNA, 332 bp, Homo sapiens
accaaccccaaatttaagcctcaaaacaaaaacactccccagcagcagccaccttggggttctagttattttggagatactgatacgaggttgagatccttgggtgagaggcccacactcctccaacccccatgtctgcttgtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccaga

SEQ ID NO: 338982 - DNA, 151 bp, Homo sapiens
acataaaatggggtaggaaatgtttcttcttttcagtgtctagaagagtttttatagatttccttctgatctttattttctttcttctggttgctttgtattttattagttcttctgtttctagatttttttttttttttttttttttttg

SEQ ID NO: 338983 - DNA, 436 bp, Homo sapiens
agatggacaattgaacttagtcccattgatgaatgtccctgcaggccagatgacgacttagcagtgatcatgccttatgtctgcatttcaagctcctgaccatgcctagtacacaagaggcctccatgaatgtttactggatgagtggatgagcaagggtgtgagagaacaaactactgggggctggtagaataaaccacaccttctctggcacacacggtcaacatagcatcattaatgtgtggttagcctgtaatcatctacatgacaaagcatgactcagtgataacatgcatttcatagttatttcttacatttctctagccttttcctatccacttccactcctgtgaagtgccatgaacatatagtatcatctgggacgatcaaagaggtagacttaatccagatcaggtagttaatgacagaccttgag

SEQ ID NO: 338984 - DNA, 410 bp, Homo sapiens
aaccccttgattcctttactgtaagggaggaacatttgacctatatgagtgaaacggaataccatgataacaggagaatctttctggagggaatatccaaacaaactaagactctcctgctaagctcattgccttttgcggtttagctgtaccttactctcatgttgcagagagaaagttggagaaggaaagtctacattgaccacagaatatcagagcttagaaggaacttggactgtacaaagaaaatgagctttctgagaggcagcatgcagtggtgaagaaaaaaagaatctggagctggattgcttagtttagattgtctttccattgctagtcatatgatcttggacaactgattaatttctcttcatctggagaagatgatggtttactccatgtggtggtgt

SEQ ID NO: 338985 - DNA, 403 bp, Homo sapiens
aaccccttgattcctttactgtaagggaggaacatttgacctatatgagtgaaacggaataccatgataacaggagaatctttctggagggaatatccaaacaaactaagactctcctgctaagctcattgccttttgcggtttagctgtaccttactctcatgttgcagagagaaagttggagaaggaaagtctacattgaccacagaatatcagagcttagaaggaacttggactgtacaaagaaaatgagctttctgagtcgtgcatgtaatccatcagggagccaccattgaggtcttccttgtgggtaaagaggacaattgtgtgtcccatggcatcctctccaaagatctccttcaccctctgtgcagcctgctggtcctgtgaggtatagcggccc

SEQ ID NO: 338986 - DNA, 185 bp, Homo sapiens
taatgtgggatttgaaacactggtggaaataattaagatttcaacagttattcagtttacttaattgtcagccaataattaaaattttatagaacttggggaaatttgactgccgggtgatggattcccatgagtctccttcttcctgaacgtctctgaattttggggggttattaccctcggtt

SEQ ID NO: 338987 - DNA, 600 bp, Homo sapiens
caggacacatatttagtggctgcagggcctgagaaggaacctaagtttggactctctgaaaagctggggtaccagccttggctctgtctcttaccagtaactgggccagtcctcacaatttcctgaaccacagcttccccatctgtaaaatgagagtcatgaccttgaatgattgctataaggagttcaagggcctggcacttcataggaactcagagaatgctagcttttgatattatgttcctatatgatccaaaacactttttgtttttcttaattttttttttttttgagacggagtcttgctctgttgcccaggctggagtgcaatggcatgatcttggattactgcaacctctgccttccaggtgcaagctattttcgtgcctcagcctcccaagtagctgggattacagatgtgcaccaccacacctggctaatttttgtatttttagtagagacagtatttcaccatgttggccgggctggtctcggactcccaacctcaggtgatccgccttccttggcctcccaaagtgcttgggattacaggcgtgagccactgcacctggccttttaaattttaaatgtagagatggg

SEQ ID NO: 338988 - DNA, 591 bp, Homo sapiens
caaacttctagaggatcctcgacggtgaactgccaaactctacctcgtcccagtggtgaactgctaactcagccgcatcccgatggtgaactgccaaactttacctcgtcccgatagtgaactgcctaactctaccgcatcctgatgaactgcttaatggcgttgtccctgggtacacattgggtgcagctcctgcagtcatgggctgctcacagccgtggcccttttggcacaaccattgttccttcttgtcttggaaacgaggacccgagggagaccatccgtccatcctaaaattgggacgtttggttttctgttgttgagttggagttatttgtagagtctagagatcagtctctaggagacgtgtgatctgcagacatttccctccatctctgggttgcatttttctgtccattgatggtgtccttcgatgcatgagaacagcctttgatgtacatgtaggggttggtcaggcagaaggacggtgtgggtggaagcgctgatgcctgaagaagggcaccgtaggcagagagaccgcatggctggcttgcagggctgggcccgcacggagagacagatgtgcacaga

SEQ ID NO: 338989 - DNA, 285 bp, Homo sapiens
catggattaacataaagttaatgctttatttggggtgagcgggggaaggactttttttctctccagcaagtgtaatcactcagtttcatcctcttctgtgatgaattgagaacaatgtagcaaatcctcctcctttacaaaggtttgggcttttgttttctgcctttcctaatttaaagtaacttaaattggcttgaatggaaacttccaggatatactccagggaaataaggccagttagacaaatttgggcttagtgagacaactctgtttaagaaggaaaaa

SEQ ID NO: 338990 - DNA, 246 bp, Homo sapiens
tgtgaaggatgggactggagggtccttaatttgagaaaccctctgctcaataagatggagaaaaggctgctgtgtatttattctgcagagaaaaatctaaactttgatgcttctggaatttaaatcttcattttttgtcataatattttcctctgtcactcaaattcaacagaatctaattagactctttcttcatctggggtctgttaacccctttacaagactagttttttttttttttggagg

SEQ ID NO: 338991 - DNA, 173 bp, Homo sapiens
caggcttagaatattctggcatcagaaggcactcagtaaacatagagaggaagaaaggaagaagatgaaatcaggagtacagattaaagtgttatctttggaagacaggcaagacatcctttgggacagaagggaaggagagaaagctggggaacatgcagataatacaagag

SEQ ID NO: 338992 - DNA, 478 bp, Homo sapiens
tctaggcctggaacatgctgctgctccttctagctgaacacccatctgtgatgtccacccccagttcccctttcctcaaatcaccatctcattttgatctcaatgcccaatgttccttcctcaggggcagcctctttctggcctcactcctcacgcttgcactcacagagcagcgtcacccctatgtgtcacctgagtccaactccaaccactccctcttggagctctaccagagactccaggctagggtgccctgggcaatttcttccatcttcctatctgctcctgtccttggtcccttggggctgggttcgtcagtcctagcctcatgtccccctacccttggtatcccaatctttaccccctactctgtgtagcaccttcattctaaggtcatggtcctttctacatgtctcatttgtatgttttttaaaaaaatctaggctgtgcgtggtgggtcacacctgtaatcccagca

SEQ ID NO: 338993 - DNA, 849 bp, Homo sapiens
  misc_feature (746)..(746): n is a, c, g, or t
  misc_feature (749)..(749): n is a, c, g, or t
  misc_feature (754)..(754): n is a, c, g, or t
  misc_feature (771)..(771): n is a, c, g, or t
  misc_feature (776)..(777): n is a, c, g, or t
  misc_feature (784)..(785): n is a, c, g, or t
  misc_feature (791)..(791): n is a, c, g, or t
  misc_feature (797)..(797): n is a, c, g, or t
  misc_feature (801)..(801): n is a, c, g, or t
  misc_feature (804)..(804): n is a, c, g, or t
  misc_feature (806)..(806): n is a, c, g, or t
gggaatcggacgccccaggtcaggcacccaggtttccagccccagtctaaggtggggtccgagcgcaggcagaacttgccctggccctgggtctagggcgctgggctctgaggctgagagctgggtgggaagtgcctggcggggccggttaggaaccacccgagactcagctaggggtgcatccaccctgctcctcccggcggctccgggaaggggagggagtgtatactgcgtgaaaggggaggtgagaaaggaggaggagaaggctgaaggagagggagggacaggaagagagaccacgtaagaatcatcccctcttacttccttgccctgtgtgcccatcgaaaggggacagtggctgtcaccaacaaatggtagtatgagaaccgtttgtgataatagaaacccagactgtgcttaaatgtgctagactaccatacagccacttgaagagtgaggtggaggccgggcgcggtggttcacgcctgtaatcccagcactttgggaggcggaggttggggatcacctgaggtcaggagtttgagaccagcctgaccaacatggtgaaaaccctctctactgaaaatacaaaaaaattagccgggcatggtggtgggcgcctgtaatcccagttactcggaaggctgaggcaggagaatcgcttgaactcggcaggcagagatgcagtgagctgaacaacagagccagactccgcctcaaaaaaaaaaaaaaaaaaaaaaacccgnggnctttntggggggggaaaagggntttgnntgggccnncagtgntcctgncccnttntntcacggggaattccggccccaagggggcgtaatcgaacccgtc

SEQ ID NO: 338994 - DNA, 490 bp, Homo sapiens
acccagttaaactggaatttcagatgcacagatgcatacttttttagtgtgagaatgtcctgtgtaatttttgggacatactaaaaagctatttcttgtttatctaaaattctatgttaactcgctgtcctgcatcttacctggcaaccttactcccctgcccccagccccaggaacctccccaactctcttccttatacctggagtagctcctcacccccttttccagcttcccagccccttcttcccgtcttctgcagggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagtgcaggtgagtagggggcccggggcctccccaaaaggacaccgagagctgccaagtacagttggacaagcttcaaaccagcaaag

SEQ ID NO: 338995 - DNA, 485 bp, Homo sapiens
taaaaataaaataaaaaacatttttaagtatataatttaatggtattaaatactttcatcatgtgcaatcatcagtcaccataactcatcttgtaaaactgaaactctgtacccattaaaacataactctccattccctccaccccctagcccctggcaaggaccactgtcctttctttctctataaatttgagtaagtactttatctaagtgtaatcatacagtatttatccttttgtgactggcttatttcacttagcataatgtcctcaaggttcatctatgttgtaccatgtcagaatttctttcctttcacctgggcagcataccaagaccccatctctaaaagaagtttaaaagaatgtttcaaaggccaggcccagtgactcacgcctgtaatcccgtactttctggggaggatcacttgacaccaggagttcaagaccagcctgggcaacatggcaagacctcttctctaccaaaaa

SEQ ID NO: 338996 - DNA, 420 bp, Homo sapiens
acccagttaaactggaatttcagatgcacagatgcatacttttttagtgtgagaatgtcctgtgtaatttttgggacatactaaaaagctatttcttgtttatctaaaattctatgttaactcgctgtcctgcatcttacctggcaaccttactcccctgcccccagccccaggaacctccccaactctcttccttatacctggagtagctcctcacccccttttccagcttcccagccccttcttcccgtcttctgcagggacgtggctcggggctatgagaacgtgcccattccctgtgtcaacggtgtggatggggagccctgccctgaggatgcaggtgagtagggggcccggggcctccccaaaaggacaccgagagctgccaagtacagttggacaagcttcaaaccagcaaag

SEQ ID NO: 338997 - DNA, 4140 bp, Homo sapiens
  misc_feature (3967)..(3967): n is a, c, g, or t
  misc_feature (3972)..(3972): n is a, c, g, or t
  misc_feature (3974)..(3974): n is a, c, g, or t
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttgctcaacaanacacnanaacaaaaaaaggggggggcttaattacccccaaggcccagttcgtacccttttgtcaagggccctagggcggttaaaggagaggggcgtaaacaggggaaagtcggtttggagcccctggggactgcaccccaagtacggaaagtagaaacccgcgatgtgaaaag

SEQ ID NO: 338998 - DNA, 3856 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 338999 - DNA, 3788 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcttttgttctcaataaatgttgggtttg

SEQ ID NO: 339000 - DNA, 3879 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctggggtgttgcattttttccaacaccttaaattctgacagagatcagcagcctgggtaagctccttcaagggtctctgaagggatgtgccccgtccattctgagtgataagggctcacacgctgtcaatggggaaaaaacggtttgggagaaagg

SEQ ID NO: 339001 - DNA, 4043 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgtgagcccctgccccgcccttgatgcccctgcccccacttcttgcagcctcagaccctgcattgggcatcctgtcccctcttcaggttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339002 - DNA, 3436 bp, Homo sapiens
gcacgggcaccacgggccccgcagagtgttttaaatcggcacgaggcatgtcaaaccaggaaatggaccccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339003 - DNA, 2068 bp, Homo sapiens
cgccattctgcctcagcctccctagtagctgggactacaggcgcctgccaccacgcccagctaattttttctattttttagtagagacagggtttcaccgtgttggccacaatggcctccatctcctgacctcgtgatccgcccgcctcggcctcccaaagtgctgggattacaggcatgagccaccgcgcccgaccctactagtcccattttttagatgaagaaactgcgacccagagacgttaagtgacttacccagggtcccacagcttgtgaatggtggagctgggattcacacacacagccaatcttgaccatttgctgctttggtgagcagggccagctgcccccaccctcactcccttcccacccacaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgtgagcccctgccccgcccttgatgcccctgcccccacttcttgcagcctcagaccctgcattgggcatcctgtcccctcttcaggttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339004 - DNA, 1095 bp, Homo sapiens
  misc_feature (33)..(33): n is a, c, g, or t
  misc_feature (68)..(68): n is a, c, g, or t
  misc_feature (75)..(75): n is a, c, g, or t
  misc_feature (77)..(77): n is a, c, g, or t
  misc_feature (84)..(85): n is a, c, g, or t
gcctgagataaagtactttcaaagatgcaaacnccacctgaacttgatgcaactaaccacctgcagantgaactntntgacaanngtctgctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339005 - DNA, 2603 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg

SEQ ID NO: 339006 - DNA, 1211 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgagagtgaaggtgagggccctcaggcccagggagcatggagtccactggggtcctgagctgccaagaagggacctatcccaaaagcggggtc

SEQ ID NO: 339007 - DNA, 751 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcataccaagaccccatctctaaaagaagtttaaaagaatgtttcaaaggccaggcccagtgactcacgcctgtaatcccgtactttctggggaggatcacttgacaccaggagttcaagaccagcctgggcaacatggcaagacctcttctctaccaaaaa

SEQ ID NO: 339008 - DNA, 219 bp, Homo sapiens
gaggacccgccaggggtcccagtaggtgaggtgcagagcctccctcagctcctcttttcctccatccaaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagag

SEQ ID NO: 339009 - DNA, 221 bp, Homo sapiens
cacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaactgcgatttttgtgt

SEQ ID NO: 339010 - DNA, 3958 bp, Homo sapiens
aagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttg
